(12) United States Patent
Franklin et al.

(10) Patent No.: US 12,110,521 B2
(45) Date of Patent: Oct. 8, 2024

(54) ENGINEERED METHIONINE GAMMA LYASE VARIANTS

(71) Applicant: Syntis Bio, Inc., Boston, MA (US)

(72) Inventors: Kierra Aleece Franklin, Dolton, IL (US); Stephanie Sue Galanie, Knoxville, TN (US); Gjalt W. Huisman, Redwood City, CA (US); Nikki D. Kruse, San Carlos, CA (US); Kerryn McCluskie, Pacifica, CA (US); Vesna Mitchell, Santa Clara, CA (US); Leann Quertinmont Teadt, Redwood City, CA (US); Kristen Jean Vallieu, Las Vegas, NV (US)

(73) Assignee: SYNTIS BIO, INC., Boston, MA (US)

( * ) Notice: Subject to any disclaimer, the term of this patent is extended or adjusted under 35 U.S.C. 154(b) by 0 days.

(21) Appl. No.: 17/749,034

(22) Filed: May 19, 2022

(65) Prior Publication Data
US 2022/0403362 A1 Dec. 22, 2022

Related U.S. Application Data

(60) Provisional application No. 63/274,349, filed on Nov. 1, 2021, provisional application No. 63/191,799, filed on May 21, 2021.

(51) Int. Cl.
| | | |
|---|---|---|
| *C12N 9/88* | (2006.01) | |
| *A61K 38/51* | (2006.01) | |
| *A61P 3/00* | (2006.01) | |
| *C12N 1/20* | (2006.01) | |
| *C12N 15/70* | (2006.01) | |
| *C12R 1/19* | (2006.01) | |

(52) U.S. Cl.
CPC .............. *C12N 9/88* (2013.01); *A61K 38/51* (2013.01); *A61P 3/00* (2018.01); *C12N 1/205* (2021.05); *C12N 15/70* (2013.01); *C12Y 404/01011* (2013.01); *C12N 2800/101* (2013.01); *C12R 2001/19* (2021.05)

(58) Field of Classification Search
CPC .......... C12N 9/88; C12N 1/205; C12N 15/70; C12N 2800/101; A61P 3/00; A61K 38/51; C12Y 404/01011; C12R 2001/19
See application file for complete search history.

(56) References Cited

U.S. PATENT DOCUMENTS

| | | |
|---|---|---|
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,863,788 A | 1/1999 | Soda et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer |
| 6,287,862 B1 | 9/2001 | Delcardayre et al. |
| 6,291,242 B1 | 9/2001 | Stemmer |
| 6,297,053 B1 | 10/2001 | Stemmer |
| 6,303,344 B1 | 10/2001 | Willem |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | Delcardayre et al. |
| 6,335,160 B1 | 1/2002 | Patten et al. |
| 6,335,198 B1 | 1/2002 | Delcardayre et al. |
| 6,337,186 B1 | 1/2002 | Krebber |
| 6,344,356 B1 | 2/2002 | Stemmer |
| 6,352,859 B1 | 3/2002 | Delcardayre et al. |
| 6,355,484 B1 | 3/2002 | Patten et al. |

(Continued)

FOREIGN PATENT DOCUMENTS

| | | |
|---|---|---|
| WO | 199522625 A1 | 8/1995 |
| WO | 199600787 A1 | 1/1996 |

(Continued)

OTHER PUBLICATIONS

"Yoshizawa S.","Khan N.H.","Nishimura M.", "Chiura H.X.", "Ogura Y.", "Hayashi T.", "Kogure K."],"title":"Draft genome of Pseudomonas putida strain KT-27.","publicationDate":"Mar. 2018" retrieved from https://www.uniprot.org/uniprotkb/A0A2S3WI91/ entry on Sep. 6, 2023. (Year: 2018).*

(Continued)

*Primary Examiner* — Louise W Humphrey
*Assistant Examiner* — John Paul Selwanes
(74) *Attorney, Agent, or Firm* — MORRISON & FOERSTER LLP

(57) ABSTRACT

The present invention provides engineered methionine gamma lyase polypeptides and compositions thereof. The engineered methionine gamma lyase polypeptides have been optimized to provide improved thermostability, protease stability, and stability under a range of pH conditions, including acidic (pH<7) conditions. The present invention also relates to the use of the compositions comprising the engineered methionine gamma lyase polypeptides for therapeutic purposes.

24 Claims, 4 Drawing Sheets

Specification includes a Sequence Listing.

(56) References Cited

U.S. PATENT DOCUMENTS

| | | |
|---|---|---|
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | Delcardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | Delcardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | Delcardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | Delcardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,560,263 B2 | 7/2009 | Kakkis et al. |
| 7,620,500 B2 | 11/2009 | Mundorff et al. |
| 7,620,502 B2 | 11/2009 | Selifonov et al. |
| 7,629,157 B2 | 12/2009 | Davis et al. |
| 7,629,170 B2 | 12/2009 | Delcardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | Delcardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | Delcardayre et al. |
| 8,383,346 B2 | 2/2013 | Colbeck et al. |
| 8,457,903 B1 | 6/2013 | Emig et al. |
| 8,504,498 B2 | 8/2013 | Fox et al. |
| 8,589,085 B2 | 11/2013 | Selifonov et al. |
| 8,762,066 B2 | 6/2014 | Fox |
| 8,768,871 B2 | 7/2014 | Fox |
| 8,849,575 B2 | 9/2014 | Gustafsson et al. |
| 9,593,326 B2 | 3/2017 | Clark et al. |
| 9,665,694 B2 | 5/2017 | Cope |
| 9,684,771 B2 | 6/2017 | Cope et al. |
| 9,864,833 B2 | 1/2018 | Fox |
| 9,996,661 B2 | 6/2018 | Gustafsson et al. |
| 10,184,117 B2 | 1/2019 | Nazor et al. |
| 2004/0110164 A1 | 6/2004 | Inagaki et al. |
| 2012/0148559 A1 | 6/2012 | Georgiou et al. |
| 2012/0177722 A1 | 7/2012 | Weiner et al. |
| 2013/0003989 A1 | 2/2013 | Okhamafe et al. |
| 2018/0171380 A1 | 6/2018 | Georgiou et al. |
| 2018/0344771 A1* | 12/2018 | Godfrin .............. A61P 19/00 |
| 2022/0056407 A1 | 2/2022 | Smith et al. |

FOREIGN PATENT DOCUMENTS

| | | |
|---|---|---|
| WO | 199700078 A1 | 1/1997 |
| WO | 199735966 A1 | 10/1997 |
| WO | 199827230 A1 | 6/1998 |
| WO | 200042561 A2 | 7/2000 |
| WO | 200175767 A2 | 10/2001 |
| WO | 2009152336 A1 | 12/2009 |
| WO | 2010144103 A1 | 12/2010 |
| WO | 2022109503 A1 | 5/2022 |

OTHER PUBLICATIONS

Batrich M, Maskeri L, Schubert R, Ho B, Kohout M, Abdeljaber M, Abuhasna A, Kholoki M, Psihogios P, Razzaq T, Sawhney S, Siddiqui S, Xoubi E, Cooper A, Hatzopoulos T, Putonti C. Pseudomonas Diversity Within Urban Freshwaters. Front Microbiol. Feb. 15, 2019;10:195. (Year: 2019).*

"Fujikawa T.", "Sawada H."],"title":"Broccoli isolated *Pseudomonas* sp.", "publication Date":"Feb. 2020" retrieved from https://www.uniprot.org/uniprotkb/A0A615RM31/entry on Sep. 6, 2023. (Year: 2020).*

Smith et al., "Comparison of biosequences," Adv. Appl. Math., 2:482-489 [1981].

Needleman et al., "A general method applicable to the search for similarities in the amino acid sequence of two proteins," J. Mol. Biol., 48:443-453 [1970].

Pearson et al., "Improved tools for biological sequence comparison," Proc. Natl. Acad. Sci. USA 85:2444-2448 [1988].

Altschul et al. "Basic local alignment search tool," J. Mol. Biol., 215: 403-410 [1990].

Altschul et al.,"Gapped BLAST and PSI-BLAST: a new generation of protein database search programs ," Nucleic Acids Res., 25,17, 3389-3402 [1977]. Published 1997.

Henikoff et al., "Amino acid substitution matrices from protein blocks," Proc. Natl. Acad. Sci. USA 89, 22:10915 [1989]. Published 1992.

(56) References Cited

OTHER PUBLICATIONS

Romanos et al., "Foreign Gene Expression in Yeast: a Review," Yeast 8:423-488 [1992].
Guo et al., "3'-End-Forming Signals of Yeast mRNA," Mol. Cell. Biol., 15, 11:5983-5990 [1995].
Stemmer, "DNA shuffling by random fragmentation and reassembly: In vitro recombination for molecular evolution," Proc. Natl. Acad. Sci. USA 91:10747-10751 [1994].
Zhao et al., "Molecular evolution by staggered extension process (StEP) in vitro recombination," Nat. Biotechnol., 16:258-261 [1998].
Caldwell et al., "Mutagenic PCR," PCR Methods Appl., 3,6 :S136-S140 [1994].
Black et al., "Creation of drug-specific herpes simplex virus type 1 thymidine kinase mutants for gene therapy," Proc. Natl. Acad. Sci. USA 93:3525-3529 [1996].
Ling et al., "Approaches to DNA Mutagenesis: An Overview," Anal. Biochem., 254(2):157-178 [1997].
Dale et al., "Oligonucleotide-Directed Random Mutagenesis Using the Phosphorothioate Method," Meth. Mol. Biol., 57:369-374 [1996].
Smith, "In Vitro Mutagenesis," Ann. Rev. Genet., 19,1:423-462 [1985].
Botstein et al., "Strategies and applications of in vitro mutagenesis," Science, 229, 4719:1193-1201 [1985].
Carter, "Site-directed mutagenesis.," Biochem. J., 237, 1:1-7 [1986].
Kramer et al., "Different base/base mismatches are corrected with different efficiencies by the methyl-directed DNA mismatch-repair system of E. coli," Cell, 38,3:879-887 [1984].
Wells et al., "Cassette mutagenesis: an efficient method for generation of multiple mutations at defined sites," Gene, 34,2-3:315-323 [1985].
Minshull et al., "Protein evolution by molecular breeding," Curr. Op. Chem. Biol., 3,3:284-290 [1999].
Christians et al., "Directed evolution of thymidine kinase for AZT phosphorylation using DNA family shuffling," Nat. Biotechnol., 17,3:259-264 [1999].
Crameri et al., "DNA shuffling of a family of genes from diverse species accelerates directed evolution," Nature, 391:288-291 [1998].
Crameri, et al., "Molecular evolution of an arsenate detoxification pathway by DNA shuffling," Nat. Biotechnol., 15:436-438 [1997].
Zhang et al., "Directed evolution of a fucosidase from a galactosidase by DNA shuffling and screening," Proc. Nat. Acad. Sci. U.S.A., 94,9:4504-4509 [1997].
Crameri et al., "Improved Green Fluorescent Protein by Molecular Evolution Using DNA Shuffling," Nat. Biotechnol., 14:315-319 [1996].
Stemmer, "Rapid evolution of a protein in vitro by DNA shuffling," Nature, 370:389-391 [1994].
Stemmer, "DNA shuffling by random fragmentation and reassembly: in vitro recombination for molecular evolution," Proc. Nat. Acad. Sci. USA, 91,22:10747-10751 [1994].
Matthes, H.W.D., et al., "Simultaneous rapid chemical synthesis of over one hundred oligonucleotides on a microscale," EMBO J., 3(4):801-05 (1984).
Beaucage, S.L., et al. "Deoxynucleoside Phosphoramidites—A New Class of Key Intermediates for Deoxypolynucleotide Synthesis." Tetrahedron Letters 22: 1859-62, 1981.
Ikeda, Amino Acids, vol. 29, 2005, pp. 283-287.

\* cited by examiner

ENGINEERED METHIONINE GAMMA LYASE VARIANTS

CROSS-REFERENCE TO RELATED APPLICATIONS

This application claims the benefit under 35 U.S.C. § 119(e) of U.S. provisional application No. 63/191,799, filed May 21, 2021, and U.S. provisional application No. 63/274,349, filed Nov. 1, 2021, all of which are incorporated herein by reference.

REFERENCE TO SEQUENCE LISTING, TABLE OR COMPUTER PROGRAM

The official copy of the Sequence Listing is submitted concurrently with the specification and has a file name of "CX7-196US3_ST25.txt", a creation date of May 16, 2022, and a size of 4.2 megabytes. The Sequence Listing filed via EFS-Web is part of the specification and is incorporated in its entirety by reference herein.

TECHNICAL FIELD

The present invention relates to engineered methionine gamma lyase polypeptides and compositions thereof. The engineered methionine gamma lyase polypeptides have been optimized to provide improved thermostability, protease stability, and stability under a range of pH conditions, including acidic (pH<7) conditions. The present invention also relates to the use of the compositions comprising the engineered methionine gamma lyase polypeptides for therapeutic purposes.

BACKGROUND OF THE INVENTION

Homocystinuria (HCU) is an autosomal recessive genetic disorder of homocysteine metabolism which leads to an abnormal accumulation of homocysteine and its metabolites (e.g., methionine, homocysteine, homocysteine-cysteine complex, etc.) in the blood and urine of affected individuals. There are numerous forms of HCU, distinguished by their signs, symptoms, and genetic causes. The most common symptoms include nearsightedness, downward dislocation of the lenses of the eyes (ectopia lentis), Marfanoid appearance, increased risk of abnormal blood clotting, brittle bones that are prone to fracturing, developmental delays, stroke, and/or seizures. Other symptoms include intellectual disabilities, failure to thrive, movement problems, and megaloblastic anemia. The signs and symptoms of HCU typically develop within the first year of life, although those who are mildly affected may not developed them until later in childhood or adulthood. The frequency of HCU in the general population is estimated to be about 1 in 200,000 to 335,000, worldwide. There is a much higher frequency in some countries (e.g., Ireland, with 1 in 65,000; Germany, with 1 in 18,000; Norway, with 1 in 6,400; and Qatar, with 1 in 1,800). Treatment and disease management largely rely on severe dietary restrictions. Pyridoxine is sometimes used, often in combination with folic acid and vitamin B12. However, some patients are pyridoxine insensitive and a low-methionine diet, in combination with betaine supplementation, is used in these individuals to reduce homocysteine levels. There are some enzyme replacement therapies under investigation, involving PEGylated human cystathione beta synthase for injection. Despite some advances, a need remains for improved treatment modalities.

SUMMARY OF THE INVENTION

The present invention provides engineered methionine gamma lyase polypeptides and compositions thereof. The engineered methionine gamma lyase polypeptides have been developed to provide enhanced properties, including, among others, improved thermostability, improved protease stability, and improved stability under a range of pH conditions, including acidic (pH<7) conditions. The invention also relates to the use of the compositions comprising the engineered methionine gamma lyase polypeptides for therapeutic purposes.

In one aspect, the present invention provides recombinant methionine gamma lyases and/or biologically active recombinant methionine gamma lyase fragments comprising polypeptide sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to a reference sequence of SEQ ID NO: 2, 94, 248, 352, 478, 832, 916, 1172, 1232, 1346, or 1488. In some embodiments, the recombinant methionine gamma lyase and/or biologically active recombinant methionine gamma lyase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to a reference sequence of SEQ ID NO: 2, 94, 248, 352, 478, 832, 916, 1172, 1232, 1346, or 1488. In some embodiments, the recombinant methionine gamma lyase and/or biologically active recombinant methionine gamma lyase fragment comprises one or more substitutions in its polypeptide sequence relative to the reference sequence of SEQ ID NO: 2, 94, 248, 352, 478, 832, 916, 1172, 1232, 1346, or 1488.

In some embodiments, the present invention provides recombinant methionine gamma lyases and/or biologically active recombinant methionine gamma lyase fragments comprising polypeptide sequences comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to the reference sequence of SEQ ID NO: 2. In some embodiments, the recombinant methionine gamma lyase and/or biologically active recombinant methionine gamma lyase fragment comprises a polypeptide sequence having at least 80%, 85%, 86%, 87%, 88%, 89%, 90%, 91%, 92%, 93%, 94%, 95%, 96%, 97%, 98%, 99%, or more sequence identity to the reference sequence of SEQ ID NO:2. In some embodiments, the polypeptide sequence of the recombinant methionine gamma lyases and/or biologically active recombinant methionine gamma lyase fragments thereof comprises one or more substitutions in its polypeptide sequence relative to the reference sequence of SEQ ID NO: 2.

In some embodiments, the recombinant methionine gamma lyase comprises a polypeptide sequence comprising at least one or more substitutions at amino acid positions: 2, 3, 4, 5, 6, 7, 8, 9, 11, 17, 21, 23, 25, 27, 29, 30, 31, 32, 33, 34, 35, 36, 38, 41, 43, 46, 47, 47, 48, 49, 50, 51, 53, 54, 55, 57, 58, 60, 62, 63, 66, 67, 68, 69, 82, 83, 87, 91, 99, 102, 111, 112, 113, 119, 124, 126, 127, 128, 132, 134, 138, 140, 141, 142, 144, 145, 146, 149, 150, 152, 154, 155, 156, 158, 160, 165, 167, 170, 173, 174, 175, 176, 177, 178, 179, 180, 181, 183, 189, 190, 193, 195, 199, 199, 206, 209, 214, 219, 220, 221, 223, 225, 228, 229, 230, 231, 232, 233, 236, 237, 239, 240, 242, 243, 245, 247, 250, 251, 252, 253, 254, 255, 256, 259, 263, 267, 269, 270, 271, 272, 275, 276, 278, 279, 281, 282, 283, 284, 287, 288, 290, 295, 296, 298, 300, 301, 304, 308, 309, 312, 314, 315, 316, 317, 322, 323, 324, 325, 327, 333, 334, 335, 336, 338, 341, 344, 348, 353, 357, 358, 361, 362, 364, 365, 366, 367, 368, 383, 384, 386, 388, 390, 391, 392, 394, 395, 396, 398, or combinations thereof, wherein the amino acid positions of the polypeptide sequence are relative to the reference sequence of SEQ ID NO: 2.

In some embodiments, the recombinant methionine gamma lyase comprises a polypeptide sequence comprising at least one or more substitutions at amino acid positions: 8, 11, 23, 55, 57, 69, 141, 165, 173, 189, 219, 223, 236, 237, 263, 267, 276, 279, 283, 290, 298, 304, 334, 341, 344, 366, 368, or combinations thereof, wherein the amino acid positions of the polypeptide sequence are relative to the reference sequence of SEQ ID NO: 2.

In some additional embodiments, the recombinant methionine gamma lyase comprises a polypeptide sequence having at least 85%, 86%, 87%, 88%, 89%, 90%, 91%, 92%, 93%, 94%, 95%, 96%, 97% 98%, 99%, or more sequence identity to SEQ ID NO: 2, or a functional fragment thereof, and wherein the polypeptide sequence comprises at least one substitution or substitution set at one or more positions 2, 6/25/38/141/173/275/366/395, 6/25/55, 6/38/55/138, 6/38/55/138/141/288/308, 6/38/55/141/180/275/362, 6/38/55/141/180/288/362/366, 6/38/55/275/288/308, 6/38/138/141/173/288/366, 6/38/141/288/366, 6/55/138/173/366, 6/55/283/362/366, 6/180/362/366, 25/38/55/275/288, 25/180/288/362, 38/55/180/362/366, 38/55/362, 38/141/173/288/308/366, 38/141/308/362/366, 38/173, 54, 54/145, 55, 69, 69/138/140/189/199/336, 69/138/145/189/199/290/344, 69/138/165/189/290/296/322/336/344/398, 69/138/189/199/366, 69/138/189/336/344, 69/138/199/263/322/344/366, 69/138/336/366, 69/140/145/322/348, 69/140/165/189/322/366, 69/145/165/296/336/344/366, 69/145/165/322, 69/145/189/199/290, 69/145/189/366/398, 69/145/199/336/344, 69/145/322/344, 69/145/344, 69/165/189/199/263/336/366, 69/165/189/263/322/336, 69/165/263/290/336, 69/165/296/398, 69/165/322, 69/165/322/344/366, 69/165/344/366, 69/189/290/344/366, 69/189/322, 69/290/344, 69/322/344/398, 138/189/263/322/366, 140/145/189, 140/145/189/322/344/366, 140/165/296/322/336, 142, 145/189, 145/189/199/263/296/336/344/366, 145/189/199/322/344/398, 145/263/290/344/398, 145/290, 152, 165/189/199/322/366, 165/322/336, 165/336/344, 170, 173/366, 177, 179, 179/251, 189, 189/290/322/336/366, 189/290/322/344, 189/290/366, 189/322, 189/322/344, 193, 232, 267, 271, 275, 278, 287, 295, 296/344, 301, 304, 309, 322, 327, 333, 361, 366, 392, and 395, wherein the amino acid positions of the polypeptide sequence are relative to the reference sequence of SEQ ID NO: 2. In some embodiments, the polypeptide sequence comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set 2S, 2T, 6S/25E/38F/141E/173V/275A/366E/395D, 6S/25E/55P, 6S/38F/55P/138S/141E/288K/308A, 6S/38F/55P/138T, 6S/38F/55P/141E/180G/275A/362E, 6S/38F/55P/141E/180G/288K/362E/366E, 6S/38F/55P/275A/288K/308A, 6S/38F/138T/141E/173V/288K/366E, 6S/38F/141E/288K/366E, 6S/55P/138T/173V/366E, 6S/55P/283H/362E/366E, 6S/180G/362E/366E, 25E/38F/55P/275A/288K, 25E/180G/288K/362E, 38F/55P/180G/362E/366E, 38F/55P/362E, 38F/141E/173V/288K/308A/366E, 38F/141E/308A/362E/366E, 38F/173V, 54I, 54Q, 54R/145S, 55K, 69I, 69I/138C/140T/189L/199T/336H, 69I/138C/145G/189L/199T/290A/344T, 69I/138C/165R/189L/290A/296N/322A/336H/344C/398P, 69I/138C/189L/199T/366Q, 69I/138C/336H/344T/366Q, 69I/145G/165R/296N/336H/344T/366Q, 69I/145G/165R/322A, 69I/145G/189L/366Q/398P, 69I/145G/199T/336H/344T, 69I/145G/322Q/344C, 69I/145G/344C, 69I/165R/189L/263P/322Q/336H, 69I/165R/263P/290A/336H, 69I/165R/322Q, 69I/165R/322Q/344C/366Q, 69I/165R/344C/366Q, 69I/290A/344T, 69I/322A/344C/398P, 69W, 69W/138C/189L/199T/366Q, 69W/138C/189L/336H/344C, 69W/138C/199T/263P/322A/344C/366Q, 69W/138C/336H/366Q, 69W/140T/145G/322Q/348V, 69W/140T/165R/189L/322A/366Q, 69W/145G/189L/199T/290A, 69W/165R/189L/199T/263P/336H/366Q, 69W/165R/296N/398P, 69W/189L/290A/344T/366Q, 69W/189L/322A, 138C/189L/263P/322Q/366Q, 140T/145G/189L, 140T/145G/189L/322A/344C/366Q, 140T/165R/296N/322Q/336H, 142L, 142S, 145G/189L, 145G/189L/199T/263P/296N/336H/344T/366Q, 145G/189L/199T/322A/344T/398P, 145G/263P/290A/344T/398P, 145G/290A, 152A, 165R/189L/199T/322Q/366Q, 165R/322A/336H, 165R/336H/344T, 170P, 170W, 173V/366E, 177T, 179A, 179S/251N, 189L, 189L/290A/322Q/336H/366Q, 189L/290A/322Q/344T, 189L/290A/366Q, 189L/322A, 189L/322A/344C, 193S, 232P, 267T, 271D, 275N, 278C, 287V, 295G, 296G/344V, 301N, 304R, 309A, 322A, 322E, 322K, 327M, 333F, 361V, 366R, 392H, and 395H, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set R2S, R2T, N6S/G25E/Y38F/Q141E/A173V/Q275A/H366E/K395D, N6S/G25E/G55P, N6S/Y38F/G55P/N138S/Q141E/L288K/R308A, N6S/Y38F/G55P/N138T, N6S/Y38F/G55P/Q141E/D180G/Q275A/Q362E, N6S/Y38F/G55P/Q141E/D180G/L288K/Q362E/H366E, N6S/Y38F/G55P/Q275A/L288K/R308A, N6S/Y38F/N138T/Q141E/A173V/L288K/H366E, N6S/Y38F/Q141E/L288K/H366E, N6S/G55P/N138T/A173V/H366E, N6S/G55P/Q283H/Q362E/H366E, N6S/D180G/Q362E/H366E, G25E/Y38F/G55P/Q275A/L288K, G25E/D180G/L288K/Q362E, Y38F/G55P/D180G/Q362E/H366E, Y38F/G55P/Q362E, Y38F/Q141E/A173V/L288K/R308A/H366E, Y38F/Q141E/R308A/Q362E/H366E, Y38F/A173V, E54I, E54Q, E54R/A145S, G55K, L69I, L69I/N138C/L140T/Y189L/E199T/S336H, L69I/N138C/A145G/Y189L/E199T/N290A/A344T, L69I/N138C/Q165R/Y189L/N290A/S296N/I322A/S336H/A344C/A398P, L69I/A145G/Q165R/S296N/S336H/A344T/H366Q, L69I/A145G/Q165R/I322A, L69I/A145G/Y189L/H366Q/A398P, L69I/A145G/E199T/S336H/A344T, L69I/A145G/I322Q/A344C, L69I/A145G/A344C, L69I/Q165R/Y189L/A263P/I322Q/S336H, L69I/Q165R/A263P/N290A/S336H, L69I/Q165R/I322Q, L69I/Q165R/I322Q/A344C/H366Q, L69I/Q165R/A344C/H366Q, L69I/N290A/A344T, L69I/I322A/A344C/A398P, L69W, L69W/N138C/Y189L/E199T/H366Q, L69W/N138C/Y189L/S336H/A344C, L69W/N138C/E199T/A263P/I322A/A344C/H366Q, L69W/N138C/S336H/H366Q, L69W/L140T/A145G/I322Q/A348V, L69W/L140T/Q165R/Y189L/I322A/H366Q, L69W/A145G/Y189L/E199T/N290A, L69W/Q165R/Y189L/E199T/A263P/S336H/H366Q, L69W/

Q165R/S296N/A398P, L69W/Y189L/N290A/A344T/H366Q, L69W/Y189L/I322A, N138C/Y189L/A263P/I322Q/H366Q, L140T/A145G/Y189L, L140T/A145G/Y189L/I322A/A344C/H366Q, L140T/Q165R/S296N/I322Q/S336H, A142L, A142S, A145G/Y189L, A145G/Y189L/E199T/A263P/S296N/S336H/A344T/H366Q, A145G/Y189L/E199T/I322A/A344T/A398P, A145G/A263P/N290A/A344T/A398P, A145G/N290A, R152A, Q165R/Y189L/E199T/I322Q/H366Q, Q165R/I322A/S336H, Q165R/S336H/A344T, A170P, A170W, A173V/H366E, R177T, H179A, H179S/D251N, Y189L, Y189L/N290A/I322Q/S336H/H366Q, Y189L/N290A/I322Q/A344T, Y189L/N290A/H366Q, Y189L/I322A, Y189L/I322A/A344C, Y193S, D232P, D267T, A271D, Q275N, E278C, E287V, P295G, S296G/A344V, A301N, Q304R, L309A, I322A, I322E, I322K, R327M, Q333F, P361V, H366R, Q392H, and K395H, wherein the amino acid positions of the polypeptide sequence are relative to the reference sequence of SEQ ID NO: 2.

In some embodiments, the present invention further provides recombinant methionine gamma lyase and/or biologically active recombinant methionine gamma lyase fragment comprising a polypeptide sequence having at least 80%, 85%, 86%, 87%, 88%, 89%, 90%, 91%, 92%, 93%, 94%, 95%, 96%, 97%, 98%, 99%, or more sequence identity to the reference sequence of SEQ ID NO: 94, 248, 352, 478, 832, 916, 1172, 1232, 1346, or 1488. In some embodiments, the recombinant methionine gamma lyase and/or biologically active recombinant methionine gamma lyase fragment comprises one or more substitutions in its polypeptide sequence relative to the reference sequence of SEQ ID NO: 94, 248, 352, 478, 832, 916, 1172, 1232, 1346, or 1488. In some embodiments of the foregoing, the polypeptide sequence comprises at least one or more substitutions at amino acid position: 2, 3, 4, 5, 6, 7, 8, 9, 11, 17, 21, 23, 25, 27, 29, 30, 31, 32, 33, 34, 35, 36, 38, 41, 43, 46, 47, 47, 48, 49, 50, 51, 53, 54, 55, 57, 58, 60, 62, 63, 66, 67, 68, 69, 82, 83, 87, 91, 99, 102, 111, 112, 113, 119, 124, 126, 127, 128, 132, 134, 138, 140, 141, 142, 144, 145, 146, 149, 150, 152, 154, 155, 156, 158, 160, 165, 167, 170, 173, 174, 175, 176, 177, 178, 179, 180, 181, 183, 189, 190, 193, 195, 199, 199, 206, 209, 214, 219, 220, 221, 223, 225, 228, 229, 230, 231, 232, 233, 236, 237, 239, 240, 242, 243, 245, 247, 250, 251, 252, 253, 254, 255, 256, 259, 263, 267, 269, 270, 271, 272, 275, 276, 278, 279, 281, 282, 283, 284, 287, 288, 290, 295, 296, 298, 300, 301, 304, 308, 309, 312, 314, 315, 316, 317, 322, 323, 324, 325, 327, 333, 334, 335, 336, 338, 341, 344, 348, 353, 357, 358, 361, 362, 364, 365, 366, 367, 368, 383, 384, 386, 388, 390, 391, 392, 394, 395, 396, 398, or combinations thereof, wherein the amino acid positions of the polypeptide sequence are relative to the reference sequence of SEQ ID NO: 94, 248, 352, 478, 832, 916, 1172, 1232, 1346, or 1488. In some embodiments, the recombinant methionine gamma lyase and/or biologically active recombinant methionine gamma lyase fragment comprises a polypeptide sequence with one or more of the following amino acid residues: 2K/S/T/W, 3A/E/P/S, 4E/G/R/V, 5G/H/I/K/P/T, 6L/P/R/S, 7E/F/G/L/S/V, 8G/P/R/S/Y, 9A/R, 11S/A/C/G/H/M/R, 17C, 21A, 23S/K, 25E, 27S, 29T, 30N, 31A, 32N, 33A/T, 34L, 35G/S, 36S, 38F, 41E, 43A, 46Q, 47G, 47Q, 48M/R, 49A/T, 50L/M/V, 5I K/N/S, 53L, 54I/Q/R, 55E/H/K/P/A/N, 57Y/H, 58T, 60T, 62A/C/H, 63G, 66Q/S, 67A/Q/R/V, 68D/G, 69R/V/I/W, 82C, 83S, 87G, 91S/L, 99A, 102A, 111H, 112A, 113M/T, 119T, 124A/H/R/S/V, 126A/E/R/S, 127A/K/Q/V, 128H, 132V, 134F, 138C/S/T, 140T, 141Q/V/E/G/P/R/S/T, 142L/S, 144R, 145G/S, 146S, 149D/T, 150T, 152A, 154V, 155F, 156L, 158S, 160M, 165R, 167T, 170G/P/Q/W, 173V/A, 174E, 175V, 176V, 177T, 178A, 179A/S/W, 180G/V, 181I, 183V, 189I/M/P/S/Y/L, 190A/G/L, 193S, 195S/T, 199T, 199W, 206I, 209G, 214C, 219L/V/I, 220I/V, 221G, 223L/I, 225C, 228A/R, 229G/H/S, 230V, 231V, 232P, 233G/M/Q/S/V, 236A/C/R/Y, 237A/G/H/K/L/R/T/V/Y, 239C/K/T/V/Y, 240D/G/P/R, 242F, 243C/G/S, 245G/S, 247M, 250F/S, 251A/N, 252C, 253G/M, 254A, 255V, 256L/V, 259L, 263G/K/P/Q/S/A, 267N/E/R/T, 269S, 270S, 271D, 272S, 275A/H/N/R/S, 276V/I/L, 278C, 279H/F/W, 281V, 282A/N/Q/V, 283N/Q/H, 284A/E/S/V, 287D/V, 288A/G/I/K/M/Q/R/S/T/W, 290N/Q/V/A/K, 295G/S/E, 296G/N, 298G/K/P/S/V/C/G/N/R/Y, 300R, 301D/E/G/K/N/Q/S, 304R/K/V, 308A/K/L/S, 309A/K, 312A, 314L, 315S, 316L, 317R, 322A/E/K/Q/V, 323K/S/T, 324S, 325A, 327M, 333F/S/T, 334V/L, 335I, 336H, 338G, 341F, 344C/T/V/A/G/R/S, 348V, 353T, 357A/G, 358C/K/L/R/T, 361V, 362R/E, 364L, 365K/R, 366Q/R/E, 367A, 368G/D, 383I, 384A/G/Q/S, 386I, 388R, 390L, 391N/E, 392H, 394P, 395A/D/H/R, 396Q/R/V, 398G/P/Q, or combinations thereof, wherein the amino acid positions of the polypeptide sequence are relative to the reference sequence of SEQ ID NO: 94, 248, 352, 478, 832, 916, 1172, 1232, 1346, or 1488.

In some embodiments, the recombinant methionine gamma lyase and/or biologically active recombinant methionine gamma lyase fragment comprises a polypeptide sequence having at least one or more substitutions at amino acid position: 8, 11, 23, 55, 57, 69, 141, 165, 173, 189, 219, 223, 236, 237, 263, 267, 276, 279, 283, 290, 298, 304, 334, 341, 344, 366, 368, or combinations thereof, wherein the amino acid positions of the polypeptide sequence are relative to the reference sequence of SEQ ID NO: 94, 248, 352, 478, 832, 916, 1172, 1232, 1346, or 1488. In some embodiments, the recombinant methionine gamma lyase and/or biologically active recombinant methionine gamma lyase fragment thereof comprises a polypeptide sequence having one or more of the following amino acid residues: 8S, 11M, 23K, 55K/S, 57Y, 69I, 141E, 165R, 173V, 189L, 219V/L, 223I, 236R, 237K, 263G, 267E, 276I, 279F, 283H, 290A/Q, 298S, 304R, 334L, 341F, 344A, 366E, 368D, or combinations thereof, wherein the amino acid positions of the polypeptide sequence are relative to the reference sequence of SEQ ID NO: 94, 248, 352, 478, 832, 916, 1172, 1232, 1346, or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set at one or more positions 38, 38/55, 38/55/150/189/290/322/361/366, 38/55/189, 38/55/189/275, 38/55/189/275/290/361, 38/55/189/278/361/366, 38/55/189/290/361/366, 38/55/189/304/322, 38/55/189/322, 38/55/189/322/366, 38/55/189/361, 38/55/275/278/290/361/366, 38/55/290/304/322/361/366, 38/55/304, 38/55/322/366, 38/149/189/275/322, 38/150/189/322/361/366, 38/189, 38/189/275/322/366, 38/189/290/322, 38/189/304/322, 38/189/304/366, 38/275, 38/278, 38/290, 38/290/322/361, 38/304, 38/322, 38/361, 38/366, 55, 55/189/322/361/366, 55/275, 55/275/366, 55/290/322, 55/304/366, 150/189/290, 189, 189/322, 278/366, and 388, wherein the amino acid positions of the polypeptide sequence are relative to the reference sequence of SEQ ID NO: 94. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO:

94, or a functional fragment thereof, and wherein the polypeptide sequence comprises at least one substitution or substitution set 38F, 38F/55E, 38F/55E/189L, 38F/55E/189L/275N/290N/361V, 38F/55E/189L/278C/361V/366E, 38F/55E/189L/322A, 38F/55E/304R, 38F/55H/189L/290N/361V/366E, 38F/55H/189L/361V, 38F/55H/290N/304R/322K/361V/366E, 38F/55K, 38F/55K/189L/275N, 38F/55K/189L/322A/366E, 38F/55K/322K/366E, 38F/55P/150T/189L/290N/322A/361V/366E, 38F/55P/189L/304R/322K, 38F/55P/189L/322A/366E, 38F/55P/275N/278C/290N/361V/366E, 38F/149T/189L/275N/322K, 38F/150T/189L/322K/361V/366E, 38F/189L, 38F/189L/275N/322K/366E, 38F/189L/290N/322K, 38F/189L/304R/322A, 38F/189L/304R/366E, 38F/275N, 38F/278C, 38F/290N, 38F/290N/322A/361V, 38F/304R, 38F/322A, 38F/361V, 38F/366E, 55H, 55H/275N, 55K, 55K/189L/322K/361V/366E, 55K/275N, 55K/275N/366E, 55K/290N/322A, 55K/304R/366E, 150T/189L/290N, 189L, 189L/322K, 278C/366E, or 388R, wherein the amino acid positions of the polypeptide sequence are relative to the reference sequence of SEQ ID NO: 94. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set Y38F, Y38F/G55E, Y38F/G55E/Y189L, Y38F/G55E/Y189L/Q275N/A290N/P361V, Y38F/G55E/Y189L/E278C/P361V/H366E, Y38F/G55E/Y189L/I322A, Y38F/G55E/Q304R, Y38F/G55H/Y189L/A290N/P361V/H366E, Y38F/G55H/Y189L/P361V, Y38F/G55H/A290N/Q304R/I322K/P361V/H366E, Y38F/G55K, Y38F/G55K/Y189L/Q275N, Y38F/G55K/Y189L/I322A/H366E, Y38F/G55K/I322K/H366E, Y38F/G55P/K150T/Y189L/A290N/I322A/P361V/H366E, Y38F/G55P/Y189L/Q304R/I322K, Y38F/G55P/Y189L/I322A/H366E, Y38F/G55P/Q275N/E278C/A290N/P361V/H366E, Y38F/P149T/Y189L/Q275N/I322K, Y38F/K150T/Y189L/I322K/P361V/H366E, Y38F/Y189L, Y38F/Y189L/Q275N/I322K/H366E, Y38F/Y189L/A290N/I322K, Y38F/Y189L/Q304R/I322A, Y38F/Y189L/Q304R/H366E, Y38F/Q275N, Y38F/E278C, Y38F/A290N, Y38F/A290N/I322A/P361V, Y38F/Q304R, Y38F/I322A, Y38F/P361V, Y38F/H366E, G55H, G55H/Q275N, G55K, G55K/Y189L/I322K/P361V/H366E, G55K/Q275N, G55K/Q275N/H366E, G55K/A290N/I322A, G55K/Q304R/H366E, K150T/Y189L/A290N, Y189L, Y189L/I322K, E278C/H366E, or A388R, wherein the amino acid positions of the polypeptide sequence are relative to the reference sequence of SEQ ID NO: 94.

In some embodiments, the recombinant methionine gamma lyase comprises a polypeptide sequence having at least 80%, 85%, 86%, 87%, 88%, 89%, 90%, 91%, 92%, 93%, 94%, 95% 96%, 97%, 98%, 99%, or more sequence identity to SEQ ID NO: 248, or a functional fragment thereof, and wherein the polypeptide sequence comprises at least one substitution or substitution set at one or more positions 11, 29, 29/34/68/220/253/279/283/358, 29/34/279, 29/47/68/102/132/220/250/358, 29/47/279/283/358, 29/220, 34, 34/43/47/283, 34/68/132/253/283, 34/132/279/358, 38, 38/54/165/173/283/336, 38/54/173/283/322/336, 38/54/189/283, 38/54/283/336, 38/54/336, 38/165/173/189, 38/165/283, 38/173, 38/173/189/290, 38/173/189/290/322, 38/173/283/336, 38/173/322, 38/283, 38/322, 43/102, 47/126/237/279, 50, 54/165/173/290/322, 54/165/189/290/336, 54/173/283, 54/189/322, 58, 68, 68/283, 68/358, 87, 112, 126, 165/173/189/283, 165/189, 165/189/283/290/336, 173/189/283/336, 189, 220, 236, 240, 279, 290, 317, 334, 357, 358, 364, and 367, wherein the amino acid positions of the polypeptide sequence are relative to the reference sequence of SEQ ID NO: 248. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set 11A, 11C, 11G, 11H, 11M, 11R, 29T, 29T/34L/68D/220V/253M/279W/283H/358T, 29T/34L/279W, 29T/47G/68D/102A/132V/220V/250F/358T, 29T/47G/279W/283H/358T, 29T/220V, 34L, 34L/43A/47G/283H, 34L/68D/132V/253M/283H, 34L/132V/279W/358T, 38F, 38F/54Q/165R/173V/283H/336H, 38F/54Q/173V/283H/322A/336H, 38F/54Q/189L/283H, 38F/54Q/283H/336H, 38F/54Q/336H, 38F/165R/173V/189L, 38F/165R/283H, 38F/173V, 38F/173V/189L/290N, 38F/173V/189L/290N/322A, 38F/173V/283H/336H, 38F/173V/322A, 38F/283H, 38F/322A, 43A/102A, 47G/126A/237V/279W, 50L, 50M, 50V, 54Q/165R/173V/290N/322A, 54Q/165R/189L/290N/336H, 54Q/173V/283H, 54Q/189L/322A, 58T, 68D/283H, 68D/358T, 68G, 87G, 112A, 126E, 126R, 126S, 165R/173V/189L/283H, 165R/189L, 165R/189L/283H/290N/336H, 173V/189L/283H/336H, 189L, 220V, 236A, 236C, 240D, 240G, 240P, 240R, 279F, 290N, 290Q, 290V, 317R, 334V, 357A, 357G, 358L, 358T, 364L, or 367A, wherein the amino acid positions of the polypeptide sequence are relative to the reference sequence of SEQ ID NO: 248. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set S11A, S11C, S11G, S11H, S11M, S11R, V29T, V29T/Q34L/A68D/T220V/S253M/H279W/Q283H/S358T, V29T/Q34L/H279W, V29T/A47G/A68D/R102A/I132V/T220V/H250F/S358T, V29T/A47G/H279W/Q283H/S358T, V29T/T220V, Q34L, Q34L/V43A/A47G/Q283H, Q34L/A68D/I132V/S253M/Q283H, Q34L/I132V/H279W/S358T, Y38F, Y38F/E54Q/Q165R/A173V/Q283H/S336H, Y38F/E54Q/A173V/Q283H/I322A/S336H, Y38F/E54Q/Y189L/Q283H, Y38F/E54Q/Q283H/S336H, Y38F/E54Q/S336H, Y38F/Q165R/A173V/Y189L, Y38F/Q165R/Q283H, Y38F/A173V, Y38F/A173V/Y189L/A290N, Y38F/A173V/Y189L/A290N/I322A, Y38F/A173V/Q283H/S336H, Y38F/A173V/I322A, Y38F/Q283H, Y38F/I322A, V43A/R102A, A47G/G126A/E237V/H279W, F50L, F50M, F50V, E54Q/Q165R/A173V/A290N/I322A, E54Q/Q165R/Y189L/A290N/S336H, E54Q/A173V/Q283H, E54Q/Y189L/I322A, F58T, A68D/Q283H, A68D/S358T, A68G, A87G, T112A, G126E, G126R, G126S, Q165R/A173V/Y189L/Q283H, Q165R/Y189L, Q165R/Y189L/Q283H/A290N/S336H, A173V/Y189L/Q283H/S336H, Y189L, T220V, L236A, L236C, K240D, K240G, K240P, K240R, H279F, A290N, A290Q, A290V, E317R, L334V, S357A, S357G, S358L, S358T, R364L, or H367A, wherein the amino acid positions of the polypeptide sequence are relative to the reference sequence of SEQ ID NO: 248.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set at one or more positions 11, 11/38, 11/38/50/54/126/189/322, 11/38/50/54/ 126/189/336/390/391, 11/38/50/54/126/240/290, 11/38/50/ 54/126/240/367, 11/38/50/54/250/290, 11/38/50/68, 11/38/ 50/126/189/240/250/290, 11/38/50/240, 11/38/50/290/367, 11/38/54, 11/38/54/68/126/290/336/367, 11/38/54/189/240/ 290, 11/38/54/189/290, 11/38/54/250/336, 11/38/68/189/ 240/290/367, 11/38/126/189/322/367, 11/38/126/322/336, 11/38/189, 11/38/189/240, 11/38/189/290/367, 11/38/189/ 322, 11/38/250/336, 11/38/290, 11/38/290/322, 11/38/290/ 322/336/367, 11/38/336, 11/50/68/126/290, 11/50/68/189/ 240, 11/50/68/290, 11/50/126, 11/50/240/250/290, 11/50/ 367, 11/54, 11/54/126, 11/54/189, 11/189/290/322, 11/240/ 250/290, 11/240/290, 11/290, 11/290/336, 11/322, 11/336, 11/394, 38/50/54/189/367, 38/54/236, 38/126/189/367, 38/126/240, 38/126/240/290, 50/54/68, 50/54/126/240/250/ 290, 50/54/240/322, 50/240, 68, 240, 322, and 336, wherein the amino acid positions of the polypeptide sequence are relative to the reference sequence of SEQ ID NO: 352. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set 11A/38F/50M/54Q/126A/ 189Y/322A, 11A/38F/50M/240R, 11A/38F/50M/290Q/ 367A, 11A/38F/54Q/68D/126A/290V/336H/367A, 11A/ 38F/54Q/189Y/240R/290V, 11A/38F/54Q/250F/336H, 11A/38F/126A/322A/336H, 11A/38F/189Y, 11A/38F/ 189Y/290V/367A, 11A/50M/68D/189Y/240R, 11A/50M/ 126A, 11A/50M/367A, 11A/54Q, 11A/54Q/189Y, 11A/ 189Y/290Q/322A, 11A/240R/290Q, 11C/38F/50M/54Q/ 126A/240R/290V, 11C/38F/50V/54Q/126A/240R/367A, 11C/38F/290Q, 11M, 11M/38F, 11M/38F/50M/54Q/126A/ 189Y/336H/390L/391E, 11M/38F/50M/54Q/250S/290Q, 11M/38F/50M/68D, 11M/38F/50M/126A/189Y/240R/ 250F/290Q, 11M/38F/50M/240R, 11M/38F/54Q, 11M/38F/ 54Q/189Y/290V, 11M/38F/68D/189Y/240R/290Q/367A, 11M/38F/126A/189Y/322A/367A, 11M/38F/189Y/240R, 11M/38F/189Y/322A, 11M/38F/250F/336H, 11M/38F/ 290Q/322A, 11M/38F/290Q/322A/336H/367A, 11M/38F/ 336H, 11M/50M/68D/126A/290Q, 11M/50M/68D/290Q, 11M/50V/240R/250S/290Q, 11M/54Q/126A, 11M/240R/ 250S/290Q, 11M/290V, 11M/290V/336H, 11M/322A, 11M/ 336H, 11M/394P, 38F/50V/54Q/189Y/367A, 38F/54Q/ 236A, 38F/126A/189Y/367A, 38F/126A/240R, 38F/126A/ 240R/290V, 50M/54Q/68D, 50M/54Q/126A/240R/250F/ 290Q, 50M/54Q/240R/322A, 50V/240R, 68D, 240R, 322A, or 336H, wherein the amino acid positions of the polypeptide sequence are relative to the reference sequence of SEQ ID NO: 352. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set S11A/ Y38F/F50M/E54Q/G126A/L189Y/I322A, S11A/Y38F/ F50M/K240R, S11A/Y38F/F50M/A290Q/H367A, S11A/ Y38F/E54Q/A68D/G126A/A290V/S336H/H367A, S11A/ Y38F/E54Q/L189Y/K240R/A290V, S11A/Y38F/E54Q/ H250F/S336H, S11A/Y38F/G126A/I322A/S336H, S11A/ Y38F/L189Y, S11A/Y38F/L189Y/A290V/H367A, S11A/ F50M/A68D/L189Y/K240R, S11A/F50M/G126A, S11A/ F50M/H367A, S11A/E54Q, S11A/E54Q/L189Y, S11A/ L189Y/A290Q/I322A, S11A/K240R/A290Q, S11C/Y38F/ F50M/E54Q/G126A/K240R/A290V, S11C/Y38F/F50V/ E54Q/G126A/K240R/H367A, S11C/Y38F/A290Q, S11M, S11M/Y38F, S11M/Y38F/F50M/E54Q/G126A/L189Y/ S336H/I390L/D391E, S11M/Y38F/F50M/E54Q/H250S/ A290Q, S11M/Y38F/F50M/A68D, S11M/Y38F/F50M/ G126A/L189Y/K240R/H250F/A290Q, S11M/Y38F/F50M/ K240R, S11M/Y38F/E54Q, S11M/Y38F/E54Q/L189Y/ A290V, S11M/Y38F/A68D/L189Y/K240R/A290Q/H367A, S11M/Y38F/G126A/L189Y/I322A/H367A, S11M/Y38F/ L189Y/K240R, S11M/Y38F/L189Y/I322A, S11M/Y38F/ H250F/S336H, S11M/Y38F/A290Q/I322A, S11M/Y38F/ A290Q/I322A/S336H/H367A, S11M/Y38F/S336H, S11M/ F50M/A68D/G126A/A290Q, S11M/F50M/A68D/A290Q, S11M/F50V/K240R/H250S/A290Q, S11M/E54Q/G126A, S11M/K240R/H250S/A290Q, S11M/A290V, S11M/ A290V/S336H, S11M/I322A, S11M/S336H, S11M/L394P, Y38F/F50V/E54Q/L189Y/H367A, Y38F/E54Q/L236A, Y38F/G126A/L189Y/H367A, Y38F/G126A/K240R, Y38F/ G126A/K240R/A290V, F50M/E54Q/A68D, F50M/E54Q/ G126A/K240R/H250F/A290Q, F50M/E54Q/K240R/ I322A, F50V/K240R, A68D, K240R, I322A, or S336, wherein the amino acid positions of the polypeptide sequence are relative to the reference sequence of SEQ ID NO: 352.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set at one or more positions 2/55/290/334/368, 2/271/290/322/368, 3/283/368, 3/368, 4/368, 5/368, 7/368, 8/368, 9/368, 21/368, 27/368, 30/368, 31/368, 32/368, 33/368, 35/368, 36/368, 46/368, 48/368, 49/368, 53/54/55/290/334/368, 53/54/55/290/368, 53/54/240/334/368, 53/54/275/279/334/336/368, 53/54/ 275/290/368, 53/54/290/368, 53/54/368, 53/240/334, 53/368, 54/55/236/279/290/334/368/392, 54/55/290/368, 54/179/368, 54/236/368, 54/240/388, 54/290/368, 55/236/ 290/368, 55/240/368, 60/368, 62/368, 66/368, 67/368, 69/368, 83/368, 91/368, 99/368, 111/195/368, 113/368, 119/ 368, 124/353/368, 124/368, 128/368, 146/368, 154/368, 156/368, 158/368, 160/368, 167/368, 173/368, 176/368, 179/279/368, 181/368, 183/368, 190/368, 195/368, 206/368, 209/368, 214/368, 219/368, 221/368, 225/368, 231/368, 236/279/368, 236/368, 239/368, 240/322, 240/334/392, 240/ 367, 240/368/388/392, 242/368, 243/368, 245/368, 247/368, 251/368, 256/298/368, 256/368, 259/368, 263/368, 269/368, 272/368, 279/368, 290/322/334/368, 290/322/334/368/392, 290/334/336/368, 290/334/368, 290/334/368/392, 290/368, 309/368, 312/368, 314/368, 315/368, 325/368, 333/334/368, 334/368, 334/368/388, 335/368, 338/368, 344/368, 368, 368/386, 368/388, 368/390, 368/391, and 368/392, wherein the amino acid positions of the polypeptide sequence are relative to the reference sequence of SEQ ID NO: 478. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set 2S/55E/290Q/334V/368D, 2S/271D/290Q/322K/368D, 3A/283N/368D, 3P/368D, 3S/368D, 4G/368D, 4R/368D, 5G/368D, 5H/368D, 5I/368D, 5K/368D, 5P/368D, 7E/368D, 7F/368D, 7G/368D, 7L/368D, 7V/368D, 8P/368D, 8R/368D, 8S/368D, 8Y/368D, 9A/368D, 21A/368D, 27S/368D, 30N/368D, 31A/368D, 32N/368D, 33A/368D, 33T/368D, 35G/368D, 35S/368D, 36S/368D, 46Q/368D, 48M/368D, 48R/368D, 49A/368D, 49T/368D, 53L/54Q/55H/290Q/334V/368D, 53L/54Q/55H/290V/368D, 53L/54Q/240R/334V/368D, 53L/54Q/275H/290V/368D, 53L/54Q/275N/279F/334V/336H/368D, 53L/54Q/290V/368D, 53L/54Q/368D, 53L/240R/334V, 53L/368D, 54Q/55H/236Y/279F/290Q/334V/368D/392H, 54Q/55H/290Q/368D, 54Q/179A/368D, 54Q/236Y/368D, 54Q/240R/388R, 54Q/290V/368D, 55H/236Y/290Q/368D, 55H/240R/368D, 60T/368D, 62A/368D, 62C/368D, 62H/368D, 66Q/368D, 66S/368D, 67A/368D, 67Q/368D, 67R/368D, 67V/368D, 69R/368D, 83S/368D, 91S/368D, 99A/368D, 111H/195S/368D, 113M/368D, 113T/368D, 119T/368D, 124A/368D, 124H/368D, 124R/353T/368D, 124S/368D, 124V/368D, 128H/368D, I46S/368D, 154V/368D, 156L/368D, 158S/368D, 160M/368D, 167T/368D, 173A/368D, 176V/368D, 179A/279F/368D, 181I/368D, 183V/368D, 190G/368D, 190L/368D, 195T/368D, 206I/368D, 209G/368D, 214C/368D, 219L/368D, 219V/368D, 221G/368D, 225C/368D, 231V/368D, 236Y/279F/368D, 236Y/368D, 239C/368D, 239T/368D, 239V/368D, 239Y/368D, 240R/322K, 240R/334V/392H, 240R/367A, 240R/368D/388R/392H, 242F/368D, 243C/368D, 243G/368D, 243S/368D, 245G/368D, 245S/368D, 247M/368D, 251A/368D, 256L/298V/368D, 256V/368D, 259L/368D, 263G/368D, 263K/368D, 263Q/368D, 263S/368D, 269S/368D, 272S/368D, 279F/368D, 290Q/322K/334V/368D, 290Q/322K/334V/368D/392H, 290Q/334V/368D, 290Q/334V/368D/392H, 290Q/368D, 290V/334V/336H/368D, 309A/368D, 312A/368D, 314L/368D, 315S/368D, 325A/368D, 333S/334V/368D, 334V/368D, 334V/368D/388R, 335I/368D, 338G/368D, 344A/368D, 344G/368D, 344R/368D, 344S/368D, 368D, 368D/386I, 368D/388R, 368D/390L, 368D/391N, or 368D/392H, wherein the amino acid positions of the polypeptide sequence are relative to the reference sequence of SEQ ID NO: 478. In some embodiments, the recombinant methionine gamma lyase comprises a polypeptide sequence having at least 80%, 85%, 86%, 87%, 8% 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set R2S/K55E/A290Q/L334V/G368D, R2S/A271D/A290Q/1322K/G368D, D3A/H283N/G368D, D3P/G368D, D3S/G368D, S4G/G368D, S4R/G368D, N5G/G368D, N5H/G368D, N5I/G368D, N5K/G368D, N5P/G368D, N7E/G368D, N7F/G368D, N7G/G368D, N7L/G368D, N7V/G368D, T8P/G368D, T8R/G368D, T8S/G368D, T8Y/G368D, G9A/G368D, P21A/G368D, A27S/G368D, P30N/G368D, P31A/G368D, V32N/G368D, Y33A/G368D, Y33T/G368D, T35G/G368D, T35S/G368D, A36S/G368D, G46Q/G368D, A48M/G368D, A48R/G368D, C49A/G368D, C49T/G368D, E53L/E54Q/K55H/A290Q/L334V/G368D, E53L/E54Q/K55H/A290V/G368D, E53L/E54Q/K240R/L334V/G368D, E53L/E54Q/Q275H/A290V/G368D, E53L/E54Q/Q275N/H279F/L334V/S336H/G368D, E53L/E54Q/A290V/G368D, E53L/E54Q/G368D, E53L/K240R/L334V, E53L/G368D, E54Q/K55H/L236Y/H279F/A290Q/L334V/G368D/Q392H, E54Q/K55H/A290Q/G368D, E54Q/H179A/G368D, E54Q/L236Y/G368D, E54Q/K240R/A388R, E54Q/A290V/G368D, K55H/L236Y/A290Q/G368D, K55H/K240R/G368D, S60T/G368D, I62A/G368D, I62C/G368D, I62H/G368D, T66Q/G368D, T66S/G368D, L67A/G368D, L67Q/G368D, L67R/G368D, L67V/G368D, I69R/G368D, G83S/G368D, G91S/G368D, T99A/G368D, R111H/Q195S/G368D, L113M/G368D, L113T/G368D, A119T/G368D, G124A/G368D, G124H/G368D, G124R/S353T/G368D, G124S/G368D, G124V/G368D, F128H/G368D, A146S/G368D, I154V/G368D, F156L/G368D, T158S/G368D, A160M/G368D, V167T/G368D, V173A/G368D, T176V/G368D, H179A/H279F/G368D, L181I/G368D, I183V/G368D, C190G/G368D, C190L/G368D, Q195T/G368D, V206I/G368D, A209G/G368D, S214C/G368D, I219L/G368D, I219V/G368D, A221G/G368D, V225C/G368D, I231V/G368D, L236Y/H279F/G368D, L236Y/G368D, L239C/G368D, L239T/G368D, L239V/G368D, L239Y/G368D, K240R/I322K, K240R/L334V/Q392H, K240R/H367A, K240R/G368D/A388R/Q392H, M242F/G368D, T243C/G368D, T243G/G368D, T243S/G368D, A245G/G368D, A245S/G368D, L247M/G368D, D251A/G368D, M256L/A298V/G368D, M256V/G368D, I259L/G368D, A263G/G368D, A263K/G368D, A263Q/G368D, A263S/G368D, H269S/G368D, N272S/G368D, H279F/G368D, A290Q/I322K/L334V/G368D, A290Q/I322K/L334V/G368D/Q392H, A290Q/L334V/G368D, A290Q/L334V/G368D/Q392H, A290Q/G368D, A290V/L334V/S336H/G368D, L309A/G368D, G312A/G368D, I314L/G368D, A315S/G368D, G325A/G368D, Q333S/L334V/G368D, L334V/G368D, L334V/G368D/A388R, F335I/G368D, A338G/G368D, T344A/G368D, T344G/G368D, T344R/G368D, T344S/G368D, G368D, G368D/L386I, G368D/A388R, G368D/I390L, G368D/D391N, or G368D/Q392H, wherein the amino acid positions of the polypeptide sequence are relative to the reference sequence of SEQ ID NO: 478.

In some embodiments, the recombinant methionine gamma lyase comprises a polypeptide sequence having at least 80%, 85%, 86%, 87%, 88%89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set at one or more positions 3/8, 8, 8/83/219/240/334/368, 8/219/272, 83, 119/315/334/368, 127/279/322, 173, 190, 206, 219, 219/263/334, 219/334/368, 263, 263/334, 272, 272/334/368, 279, 279/368, 315/334, 322, 322/368, 334, 334/368, and 368, wherein the amino acid positions of the polypeptide sequence are relative to the reference sequence of SEQ ID NO: 832. In some embodiments, the recombinant methionine gamma lyase comprises a polypeptide sequence having at least 80%, 85%, 86%, 87%, 88%, 89%, 90%, 91%, 92%, 93% 94%, 95%, 96%, 97%, 98%, 99%, or more sequence identity to SEQ ID NO: 832, or a functional fragment thereof, and wherein the polypeptide sequence comprises at least one substitution or substitution set 3P/8S, 8S, 8S/83S/219V/240R/334L/368G, 8S/219V/272S, 83S, 119T/315S/334L/368G, 127Q/279F/322K, 173A, 190G, 206I, 219V, 219V/263G/334L, 219V/334L/368G, 263G, 263G/334L, 272S, 272S/334L/368G, 279F, 279F/368G, 315S/334L, 322K, 322K/368G, 334L, 334L/368G, or 368G, wherein the amino acid positions of the polypeptide sequence are relative to the reference sequence of SEQ ID NO: 832. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set D3P/T8S, T8S, T8S/G83S/I219V/K240R/V334L/D368G, T8S/I219V/N272S, G83S, A119T/A315S/V334L/D368G, E127Q/H279F/I322K, V173A, C190G, V206I, I219V, I219V/A263G/V334L, I219V/V334L/D368G, A263G, A263G/V334L, N272S, N272S/V334L/D368G, H279F, H279F/D368G, A315S/V334L, I322K, I322K/D368G, V334L, V334L/D368G, or D368G, wherein the amino acid positions of the polypeptide sequence are relative to the reference sequence of SEQ ID NO: 832.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set at one or more positions 3/57/173, 3/141/395, 5, 5/7, 5/7/54/57/344, 5/7/149, 5/41/272/279, 5/127/149/240/344/395, 5/141/178/240, 5/240, 5/240/272/298/344, 6, 7/41/149/344, 7/54/127/228/240/298/344, 7/57/141/279/298/395, 7/127/240, 7/178/240, 7/240, 7/240/272/395, 7/272, 23, 51, 54/57/344, 54/127/282, 54/272, 57, 57/127/344, 57/141/344, 57/240, 57/272, 57/298, 127, 127/149/240/298, 127/149/272/279/282/298/344, 127/240, 127/279/282/344, 127/344, 141, 141/149/344, 141/263/272/344, 141/279, 144, 149, 149/240/272, 149/272/282/298/344, 149/272/344/395, 149/282, 149/298, 149/344, 189, 190, 219, 223, 228, 229, 233/240/263/272/395, 239, 240, 240/263, 240/344, 252, 255, 256, 263, 270, 276, 279/282, 282, 284, 288, 298, 301, 315, 316, 323, 324, 335, 341, 344, 344/395, 362, 365, 384, 395, 396, and 398, wherein the amino acid positions of the polypeptide sequence are relative to the reference sequence of SEQ ID NO: 916. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set 3P/57Y/173A, 3P/141E/395D, 5H, 5H/7E, 5H/7E/54R/57Y/344A, 5H/7E/149D, 5H/41E/272S/279F, 5H/127K/149D/240R/344A/395D, 5H/141E/178A/240R, 5H/240R, 5H/240R/272S/298P/344A, 6L, 6R, 6S, 7E/41E/149D/344A, 7E/54R/127K/228A/240R/298P/344A, 7E/57Y/141E/279F/298P/395D, 7E/127K/240R, 7E/178A/240R, 7E/240R, 7E/240R/272S/395D, 7E/272S, 23K, 51K, 51N, 51S, 54R/57Y/344A, 54R/127K/282A, 54R/272S, 57Y, 57Y/127K/344A, 57Y/141E/344A, 57Y/240R, 57Y/272S, 57Y/298P, 127A, 127K, 127K/149D/240R/298P, 127K/149D/272S/279F/282A/298P/344A, 127K/240R, 127K/279F/282A/344A, 127K/344A, 127V, 141E, 141E/149D/344A, 141E/263A/272S/344A, 141E/279F, 141G, 141P, 141R, 141S, 141T, 144R, 149D, 149D/240R/272S, 149D/272S/282A/298P/344A, 149D/272S/344A/395D, 149D/282A, 149D/298P, 149D/344A, 149T, 189I, 190A, 219L, 223I, 228R, 229H, 229S, 233Q/240R/263A/272S/395D, 239K, 240R, 240R/263A, 240R/344A, 252C, 255V, 256L, 263A, 270S, 276I, 276L, 279F/282A, 282A, 282N, 282V, 284A, 284S, 288A, 288G, 288I, 288M, 288Q, 288R, 288S, 288T, 288W, 298G, 298K, 298P, 298S, 301D, 301E, 301K, 301Q, 315S, 316L, 323K, 323T, 324S, 335I, 341F, 344A, 344A/395D, 362R, 365K, 384S, 395D, 395R, 396R, 396V, 398G, or 398Q, wherein the amino acid positions of the polypeptide sequence are relative to the reference sequence of SEQ ID NO: 916. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set D3P/H57Y/V173A, D3P/Q141E/K395D, N5H, N5H/N7E, N5H/N7E/E54R/H57Y/T344A, N5H/N7E/P149D, N5H/P41E/N272S/H279F, N5H/E127K/P149D/K240R/T344A/K395D, N5H/Q141E/G178A/K240R, N5H/K240R, N5H/K240R/N272S/A298P/T344A, N6L, N6R, N6S, N7E/P41E/P149D/T344A, N7E/E54R/E127K/K228A/K240R/A298P/T344A, N7E/H57Y/Q141E/H279F/A298P/K395D, N7E/E127K/K240R, N7E/G178A/K240R, N7E/K240R, N7E/K240R/N272S/K395D, N7E/N272S, S23K, A51K, A51N, A51S, E54R/H57Y/T344A, E54R/E127K/R282A, E54R/N272S, H57Y, H57Y/E127K/T344A, H57Y/Q141E/T344A, H57Y/K240R, H57Y/N272S, H57Y/A298P, E127A, E127K, E127K/P149D/K240R/A298P, E127K/P149D/N272S/H279F/R282A/A298P/T344A, E127K/K240R, E127K/H279F/R282A/T344A, E127K/T344A, E127V, Q141E, Q141E/P149D/T344A, Q141E/G263A/N272S/T344A, Q141E/H279F, Q141G, Q141P, Q141R, Q141S, Q141T, K144R, P149D, P149D/K240R/N272S, P149D/N272S/R282A/A298P/T344A, P149D/N272S/T344A/K395D, P149D/R282A, P149D/A298P, P149D/T344A, P149T, L189I, C190A, V219L, L223I, K228R, A229H, A229S, R233Q/K240R/G263A/N272S/K395D, L239K, K240R, K240R/G263A, K240R/T344A, A252C, L255V, M256L, G263A, C270S, V276I, V276L, H279F/R282A, R282A, R282N, R282V, P284A, P284S, L288A, L288G, L288I, L288M, L288Q, L288R, L288S, L288T, L288W, A298G, A298K, A298P, A298S, A301D, A301E, A301K, A301Q, A315S, F316L, E323K, E323T, A324S, F335I, L341F, T344A, T344A/K395D, Q362R, A365K, D384S, K395D, K395R, A396R, A396V, A398G, or A398Q, wherein the amino acid positions of the polypeptide sequence are relative to the reference sequence of SEQ ID NO: 916.

In some embodiments, the recombinant methionine gamma lyase comprises a polypeptide sequence having at least 80%, 85%, 86%, 87%, 8% 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set at one or more positions 23/219/223/276/288/298/301/365, 23/219/239/341, 23/219/240/276/279, 23/219/240/276/279/298, 23/219/240/276/298/324, 23/219/276/298, 23/219/276/341, 23/219/298/341, 23/239/240/255/276/279/298/324, 23/239/255/276/279/335/341, 23/240/255/276/324/335, 23/240/255/279, 23/240/276/298, 23/255/276/298, 23/263/276/279/282/298/341, 23/276/282/335, 23/276/298/324, 23/276/298/324/335, 23/279/282/335/396, 23/279/335, 23/341, 219/223/240/279, 219/223/276/298/341/396, 219/223/276/335, 219/240, 219/240/276/335, 219/276/279/282, 219/276/279/298/301, 219/276/298/324/335, 219/276/335, 219/279/341, 223/229/279/335, 223/255, 223/335/365, 229/255/276/282/341, 239/240/255/276/298/316/335, 239/240/276/316, 239/240/276/341, 239/279/298/335/341, 239/279/341, 240, 240/276/279, 240/279, 240/298, 255/298/341, 263/270/276, 276/279/298/316, 276/279/324/335/341, 276/298/324/335, 276/335/341, 276/341, 279/341, 298/301, 298/341, 335, and 341, wherein the amino acid positions of the polypeptide sequence are relative to the reference sequence of SEQ ID NO: 1172. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set 23K/219L/223I/276I/288K/298K/301Q/365K, 23K/219L/239K/341F, 23K/219L/240R/276I/279F, 23K/219L/240R/276I/279F/298K, 23K/219L/240R/276I/298K/324S, 23K/219L/276I/298K, 23K/219L/276I/341F, 23K/219L/298K/341F, 23K/239K/240R/255V/276I/279F/

298P/324S, 23K/239K/255V/276I/279F/335I/341F, 23K/ 240R/255V/276I/324S/335I, 23K/240R/255V/279F, 23K/ 240R/276I/298K, 23K/255V/276I/298K, 23K/263A/276I/ 279F/282A/298K/341F, 23K/276I/282A/335I, 23K/276I/ 298K/324S, 23K/276I/298K/324S/335I, 23K/279F/282A/ 335I/396V, 23K/279F/335I, 23K/341F, 219L/223I/240R/ 279F, 219L/223I/276I/298P/341F/396V, 219L/223I/276I/ 335I, 219L/240R, 219L/240R/276I/335I, 219L/276I/279F/ 282A, 219L/276I/279F/298K/301Q, 219L/276I/298K/ 324S/335I, 219L/276I/335I, 219L/279F/341F, 223I/229S/ 279F/335I, 223I/255V, 223I/335I/365K, 229S/255V/276I/ 282A/341F, 239K/240R/255V/276I/298P/316L/335I, 239K/ 240R/276I/316L, 239K/240R/276I/341F, 239K/279F/298K/ 335I/341F, 239K/279F/341F, 240R, 240R/276I/279F, 240R/ 279F, 240R/298K, 255V/298K/341F, 263A/270S/276I, 276I/279F/298P/316L, 276I/279F/324S/335I/341F, 276I/ 298K/324S/335I, 276I/335I/341F, 276I/341F, 279F/341F, 298P/301Q, 298P/341F, 335I, or 341F, wherein the amino acid positions of the polypeptide sequence are relative to the reference sequence of SEQ ID NO: 1172. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set S23K/V219L/L223I/V276I/L288I/A298K/ A301Q/A365K, S23K/V219L/L239K/L341F, S23K/ V219L/K240R/V276I/H279F, S23K/V219L/K240R/V276I/ H279F/A298K, S23K/V219L/K240R/V276I/A298K/ A324S, S23K/V219L/V276I/A298K, S23K/V219L/V276I/ L341F, S23K/V219L/A298K/L341F, S23K/L239K/K240R/ L255V/V276I/H279F/A298P/A324S, S23K/L239K/ L255V/V276I/H279F/F335I/L341F, S23K/K240R/L255V/ V276I/A324S/F335I, S23K/K240R/L255V/H279F, S23K/ K240R/V276I/A298K, S23K/L255V/V276I/A298K, S23K/ G263A/V276I/H279F/R282A/A298K/L341F, S23K/V276I/ R282A/F335I, S23K/V276I/A298K/A324S, S23K/V276I/ A298K/A324S/F335I, S23K/H279F/R282A/F335I/A396V, S23K/H279F/F335I, S23K/L341F, V219L/L223I/K240R/ H279F, V219L/L223I/V276I/A298P/L341F/A396V, V219L/L223I/V276I/F335I, V219L/K240R, V219L/ K240R/V276I/F335I, V219L/V276I/H279F/R282A, V219L/V276I/H279F/A298K/A301Q, V219L/V276I/ A298K/A324S/F335I, V219L/V276I/F335I, V219L/ H279F/L341F, L223I/A229S/H279F/F335I, L223I/L255V, L223I/F335I/A365K, A229S/L255V/V276I/R282A/L341F, L239K/K240R/L255V/V276I/A298P/F316L/F335I, L239K/K240R/V276I/F316L, L239K/K240R/V276I/ L341F, L239K/H279F/A298K/F335I/L341F, L239K/ H279F/L341F, K240R, K240R/V276I/H279F, K240R/ H279F, K240R/A298K, L255V/A298K/L341F, G263A/ C270S/V276I, V276I/H279F/A298P/F316L, V276I/H279F/ A324S/F335I/L341F, V276I/A298K/A324S/F335I, V276I/ F335I/L341F, V276I/L341F, H279F/L341F, A298P/A301Q, A298P/L341F, F335I, or L341F, wherein the amino acid positions of the polypeptide sequence are relative to the reference sequence of SEQ ID NO: 1172.

In some embodiments, the recombinant methionine gamma lyase comprises a polypeptide sequence having at least 80%, 85%, 86%, 87%, 88% 89%, 90%, 91%, 92%, 93% 94%, 95%, 96%, 97%, 98%, 99%, or more sequence identity to SEQ ID NO: 1232, or a functional fragment thereof, and wherein the polypeptide sequence comprises at least one substitution or substitution set at one or more positions 2, 3, 4, 5, 7, 8, 17, 47, 50, 55, 132, 134, 145, 170, 174, 179, 223, 223/239, 223/239/240, 223/239/240/279/335, 223/239/255/316, 223/239/298/316, 223/239/316/335, 223/ 240/298, 223/255, 223/255/298, 223/255/298/316, 223/255/ 335, 223/279/298, 223/279/298/335, 223/279/335, 223/288, 223/288/298, 223/298, 223/316, 223/335, 236, 237, 239, 239/279/298/316, 239/288, 240/255, 240/279, 240/288/335, 255, 255/279, 255/298, 255/335, 267, 275, 279, 279/298/ 335, 287, 288, 290/295, 295, 298, 298/335, 309, 316, 322, 333, 358, and 383, wherein the amino acid positions of the polypeptide sequence are relative to the reference sequence of SEQ ID NO: 1232. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set 2K, 2W, 3E, 3S, 4E, 4V, 5T, 7L, 7S, 8G, 8P, 8S, 17C, 47Q, 50M, 55E, 55N, 55P, 55S, 132V, 134F, 145G, 145S, 170G, 170Q, 174E, 179W, 223I, 223I/239K, 223I/239K/240R, 223I/ 239K/240R/279F/335I, 223I/239K/255V/316L, 223I/239K/ 298K/316L, 223I/239K/316L/335I, 223I/240R/298S, 223I/ 255V, 223I/255V/298K, 223I/255V/298K/316L, 223I/ 255V/335I, 223I/279F/298S, 223I/279F/298S/335I, 223I/ 279F/335I, 223I/288I, 223I/288I/298K, 223I/298S, 223I/ 316L, 223I/335I, 236R, 237A, 237G, 237H, 237K, 237L, 237R, 237V, 237Y, 239K, 239K/279F/298K/316L, 239K/ 288I, 240R/255V, 240R/279F, 240R/288I/335I, 255V, 255V/279F, 255V/298P, 255V/335I, 267N, 267R, 275R, 275S, 279F, 279F/298K/335I, 287D, 288I, 290K/295S, 295E, 298K, 298K/335I, 309A, 309K, 316L, 322V, 333T, 358C, 358K, 358R, or 383I, wherein the amino acid positions of the polypeptide sequence are relative to the reference sequence of SEQ ID NO: 1232. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set R2K, R2W, D3E, D3S, S4E, S4V, N5T, N7L, N7S, T8G, T8P, T8S, H17C, A47Q, F50M, K55E, K55N, K55P, K55S, I132V, H134F, A145G, A145S, A170G, A170Q, D174E, H179W, L223I, L223I/L239K, L223I/L239K/ K240R, L223I/L239K/K240R/H279F/F335I, L223I/ L239K/L255V/F316L, L223I/L239K/A298K/F316L, L223I/L239K/F316L/F335I, L223I/K240R/A298S, L223I/ L255V, L223I/L255V/A298K, L223I/L255V/A298K/ F316L, L223I/L255V/F335I, L223I/H279F/A298S, L223I/ H279F/A298S/F335I, L223I/H279F/F335I, L223I/L288I, L223I/L288I/A298K, L223I/A298S, L223I/F316L, L223I/ F335I, L236R, E237A, E237G, E237H, E237K, E237L, E237R, E237V, E237Y, L239K, L239K/H279F/A298K/ F316L, L239K/L288I, K240R/L255V, K240R/H279F, K240R/L288I/F335I, L255V, L255V/H279F, L255V/ A298P, L255V/F335I, D267N, D267R, Q275R, Q275S, H279F, H279F/A298K/F335I, E287D, L288I, Q290K/ P295S, P295E, A298K, A298K/F335I, L309A, L309K, F316L, I322V, Q333T, S358C, S358K, S358R, or V383I, wherein the amino acid positions of the polypeptide sequence are relative to the reference sequence of SEQ ID NO: 1232.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set at one or more positions 5, 5/8/50/132, 5/8/55/132/236/237, 5/8/236/237/267, 5/50, 5/50/236/237/267, 5/55/132, 5/236/237, 8, 8/50, 8/50/55/132/237, 8/50/237, 8/55, 8/55/236/237/267, 8/55/267, 8/132/236, 8/236/237, 8/237, 8/237/267, 11/23/276/279/368, 11/368, 23/57/141/223, 50, 50/55/132/237/267, 50/132/180/237, 50/132/236, 50/132/237/267, 50/236/237, 55/132, 55/132/236/237, 55/132/237, 55/236/237, 55/236/237/267, 55/267, 57, 132, 132/236/237, 132/267, 173/263/283/368, 189/368, 219, 219/223/276/279/283/368, 223/368, 236, 236/237, 236/237/267, 237, 237/267, 263, and 283, wherein the amino acid positions of the polypeptide sequence are relative to the reference sequence of SEQ ID NO: 1346. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set 5T, 5T/8S/50M/132V, 5T/8S/55A/132V/236R/237T, 5T/8S/236R/237H/267E, 5T/50M, 5T/50M/236R/237T/267E, 5T/55S/132V, 5T/236R/237H, 8S, 8S/50M, 8S/50M/55P/132V/237H, 8S/50M/237K, 8S/55A/267E, 8S/55S, 8S/55S/236R/237K/267E, 8S/132V/236R, 8S/236R/237G, 8S/236R/237K, 8S/237H, 8S/237R, 8S/237R/267E, 11S/23S/276V/279H/368G, 11S/368G, 23S/57H/141Q/223L, 50M, 50M/55P/132V/237G/267E, 50M/132V/180V/237H, 50M/132V/236R, 50M/132V/237T/267E, 50M/236R/237R, 55A/236R/237K, 55P/132V/237H, 55P/267E, 55S/132V, 55S/132V/236R/237H, 55S/236R/237T/267E, 57H, 132V, 132V/236R/237A, 132V/267E, 173A/263A/283Q/368G, 189Y/368G, 219I, 219I/223L/276V/279H/283Q/368G, 223L/368G, 236R, 236R/237H/267E, 236R/237R, 237H, 237H/267E, 263A, or 283Q, wherein the amino acid positions of the polypeptide sequence are relative to the reference sequence of SEQ ID NO: 1346. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set N5T, N5T/T8S/F50M/I132V, N5T/T8S/K55A/J132V/L236R/E237T, N5T/T8S/L236R/E237H/D267E, N5T/F50M, N5T/F50M/L236R/E237T/D267E, N5T/K55S/I132V, N5T/L236R/E237H, T8S, T8S/F50M, T8S/F50M/K55P/I132V/E237H, T8S/F50M/E237K, T8S/K55A/D267E, T8S/K55S, T8S/K55S/L236R/E237K/D267E, T8S/I132V/L236R, T8S/L236R/E237G, T8S/L236R/E237K, T8S/E237H, T8S/E237R, T8S/E237R/D267E, M11S/K23S/1276V/F279H/D368G, M11S/D368G, K23S/Y57H/E141Q/J223L, F50M, F50M/K55P/I132V/E237G/D267E, F50M/I132V/D180V/E237H, F50M/I132V/L236R, F50M/I132V/E237T/D267E, F50M/L236R/E237R, K55A/L236R/E237K, K55P/I132V/E237H, K55P/D267E, K55S/I132V, K55S/I132V/L236R/E237H, K55S/L236R/E237T/D267E, Y57H, I132V, I132V/L236R/E237A, I132V/D267E, V173A/G263A/H283Q/D368G, L189Y/D368G, L219I, L219I/I223L/I276V/F279H/H283Q/D368G, I223L/D368G, L236R, L236R/E237H/D267E, L236R/E237R, E237H, E237H/D267E, G263A, or H283Q, wherein the amino acid positions of the polypeptide sequence are relative to the reference sequence of SEQ ID NO: 1346.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set at one or more positions 6, 9, 63, 69, 82, 93, 126, 141, 155, 175, 189, 199, 220, 221, 229, 230, 233, 253, 254, 282, 284, 298, 300, 301, 304, 308, 323, 362, 365, 384, 395, 396, and 398, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set 6P, 9R, 63G, 69V, 82C, 93L, 126R, 141V, 155F, 175V, 189P, 189S, 199W, 220I, 221G, 229G, 230V, 233G, 233M, 233Q, 233S, 233V, 253G, 254A, 282Q, 284E, 284S, 284V, 298C, 298G, 298N, 298R, 300R, 301G, 301S, 304K, 304V, 308K, 308L, 308S, 323S, 362E, 365R, 384A, 384G, 384Q, 395A, 395R, 396Q, 396R, or 398G, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set N6P, G9R, S63G, I69V, A82C, I93L, G126R, E141V, Y155F, A175V, L189P, L189S, E199W, T220I, A221G, A229G, L230V, R233G, R233M, R233Q, R233S, R233V, S253G, L254A, R282Q, P284E, P284S, P284V, S298C, S298G, S298N, S298R, Y300R, A301G, A301S, R304K, R304V, R308K, R308L, R308S, E323S, Q362E, A365R, D384A, D384G, D384Q, K395A, K395R, A396Q, A396R, or A398G, wherein the amino acid positions of the polypeptide sequence are relative to the reference sequence of SEQ ID NO: 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set at one or more positions 189/230/233/298/395/398, 230, 230/233/281, 230/233/298/301/362/384/395, 230/233/298/301/395, 230/233/298/362, 230/233/308/384/395, 230/233/362/395, 230/233/384/395, 230/233/384/395/398, 230/362/395, 233, 233/298/301/362, 233/298/308/384/395, 233/298/362, 233/362, 233/362/395, 233/362/395/398, 233/384/395, 233/395, 298, 298/301, 298/301/308/384, 298/362/384, 362/384, 384/398, 395/398, and 398, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set 189M/230V/233S/298N/395R/398G, 230V, 230V/233M/298N/301S/395S, 230V/233M/362E/395R, 230V/233M/384G/395R, 230V/233Q/281V, 230V/233Q/298N/301S/395R, 230V/233Q/298N/362E, 230V/233Q/298R/301S/362E/384G/395R, 230V/233Q/298R/301S/395R, 230V/233Q/

308K/384G/395R, 230V/233Q/384G/395R/398G, 230V/233S/298N/301S/362E/384G/395R, 230V/362E/395R, 233G/395R, 233M, 233M/298N/308K/384G/395R, 233M/298N/362E, 233M/362E/395R/398G, 233Q, 233Q/298N/301S/362E, 233Q/298R/362E, 233Q/384G/395R, 233S/362E, 233S/362E/395R, 233S/384G/395R, 298N/301S/308K/384G, 298N/362E/384G, 298R, 298Y/301S, 362E/384G, 384G/398G, 395R/398G, or 398G, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set L189M/L230V/R233S/S298N/K395R/A398G, L230V, L230V/R233M/S298N/A301S/K395R, L230V/R233M/Q362E/K395R, L230V/R233M/D384G/K395R, L230V/R233Q/A281V, L230V/R233Q/S298N/A301S/K395R, L230V/R233Q/S298N/Q362E, L230V/R233Q/S298R/A301S/Q362E/D384G/K395R, L230V/R233Q/S298R/A301S/K395R, L230V/R233Q/S298N/308K/D384G/K395R, L230V/R233Q/D384G/K395R/A398G, L230V/R233S/S298N/A301S/Q362E/D384G/K395R, L230V/Q362E/K395R, R233G/K395R, R233M, R233M/S298N/R308K/D384G/K395R, R233M/S298N/Q362E, R233M/Q362E/K395R/A398G, R233Q, R233Q/S298N/A301S/Q362E, R233Q/S298R/Q362E, R233Q/D384G/K395R, R233S/Q362E, R233S/Q362E/K395R, R233S/D384G/K395R, S298N/A301S/R308K/D384G, S298N/Q362E/D384G, S298R, S298Y/A301S, Q362E/D384G, D384G/A398G, K395R/A398G, or A398G, wherein the amino acid positions of the polypeptide sequence are relative to the reference sequence of SEQ ID NO: 1488.

In some additional embodiments, the recombinant methionine gamma lyase comprises at least one mutation in at least one position as provided in Tables 3-1, 3-2, 3-3, 3-4, 3-5, 3-6, 3-7, 3-8, 3-9, 3-10, 3-11, and/or 3-12, wherein the positions are relative to the reference sequence of SEQ ID NO: 2, 94, 248, 352, 478, 832, 916, 1172, 1232, 1346, or 1488. In some embodiments, the recombinant methionine gamma lyase comprises a polypeptide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the even-numbered sequences of SEQ ID NOS: 2-1734. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to at least one sequence set forth in the even-numbered sequences of SEQ ID NOS: 2-1734.

In some embodiments, the recombinant methionine gamma lyase comprises at least one sequence set forth in the even-numbered sequences of SEQ ID NOS: 2-1734 or SEQ ID NOS: 4-1734. In some embodiments, the recombinant methionine gamma lyase comprises the polypeptide sequence of SEQ ID NO: 94, 248, 352, 478, 832, 916, 1172, 1232, 1346, 1488 or 1706. In some embodiments, the recombinant methionine gamma lyase comprises the polypeptide sequence of an even-numbered sequence of SEQ ID NOS: 1668-1734.

In some embodiments, the recombinant methionine gamma lyase described herein have one or more improved properties as compared to a reference methionine gamma lyase polypeptide. In some embodiments, the recombinant methionine gamma lyase is more thermostable than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pHs less than 7, than the methionine gamma lyase polypeptide of reference sequence of SEQ ID NO: 2, 94, 248, 352, 478, 832, 916, 1172, 1232, 1346, and/or 1488. In some additional embodiments, the recombinant methionine gamma lyase is more stable at pH 7, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pHs less than 5, than the methionine gamma lyase polypeptide of reference sequence of SEQ ID NO: 2, 94, 248, 352, 478, 832, 916, 1172, 1232, 1346, and/or 1488. In some additional embodiments, the recombinant methionine gamma lyase is more stable at pH 5, than the methionine gamma lyase polypeptide of reference sequence of SEQ ID NO: 2, 94, 248, 352, 478, 832, 916, 1172, 1232, 1346, and/or 1488. In some additional embodiments, the recombinant methionine gamma lyase is more stable at pH 5.2, than the methionine gamma lyase polypeptide of reference sequence of SEQ ID NO: 2, 94, 248, 352, 478, 832, 916, 1172, 1232, 1346, and/or 1488.

In some embodiments, the recombinant methionine gamma lyase is more resistant to protease than the methionine gamma lyase polypeptide of reference sequence of SEQ ID NO: 2, 94, 248, 352, 478, 832, 916, 1172, 1232, 1346, and/or 1488. In some additional embodiments, the recombinant methionine gamma lyase is more resistant to protease at pH 5, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more resistant to protease at pHs less than 5, than the methionine gamma lyase polypeptide of reference sequence of SEQ ID NO: 2, 94, 248, 352, 478, 832, 916, 1172, 1232, 1346, and/or 1488. In some embodiments, the resistance is to proteases trypsin and/or chymotrypsin. In some embodiments, the reference methionine gamma lyase polypeptide is the reference sequence of SEQ ID NO: 2.

In some embodiments, the recombinant methionine gamma lyase is more resistant to proteolysis than the methionine gamma lyase polypeptide of reference sequence of SEQ ID NO: 2, 94, 248, 352, 478, 832, 916, 1172, 1232, 1346, and/or 1488. In some additional embodiments, the recombinant methionine gamma lyase is more resistant to proteolysis at pH 5 than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more resistant to proteolysis at pHs less than 5 than the methionine gamma lyase polypeptide of reference sequence of SEQ ID NO: 2, 94, 248, 352, 478, 832, 916, 1172, 1232, 1346, and/or 1488. In some embodiments, the reference methionine gamma lyase polypeptide is the reference sequence of SEQ ID NO: 2.

In some embodiments, the recombinant methionine gamma lyase is more active in the presence of at least one bile salt than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt at pH 7 than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt at pHs less than 7 than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt at pH 5 than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt stable at pHs less than 5 than the methionine gamma lyase polypeptide of reference sequence of SEQ ID NO: 2, 94, 248, 352, 478, 832, 916, 1172, 1232, 1346, and/or 1488. In some embodiments, the reference methionine gamma lyase polypeptide is the reference sequence of SEQ ID NO: 2.

In yet some additional embodiments, the recombinant methionine gamma lyase is more stable at acidic pHs, more thermostable, more resistant to proteolysis, and/or more active in the presence of at least one bile salt than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least one improved property selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments the reference methionine gamma lyase polypeptide is the reference sequence of SEQ ID NO: 2.

In some embodiments, the recombinant methionine gamma lyase exhibits at least one improved property selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least two improved properties selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least three improved properties selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits the improved properties of improved stability at acidic pHs, improved thermostability, improved resistance to proteolysis, and improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least one improved property selected from improved stability at acidic pHs, improved thermostability, improved resistance to proteolysis, and/or improved activity in the presence of at least one bile salt, as well as at least one additional improved property, as compared to the methionine gamma lyase polypeptide of reference sequence of SEQ ID NO: 2, 94, 248, 352, 478, 832, 916, 1172, 1232, 1346, and/or 1488. In some embodiments of the foregoing, the acidic pH is a pH of 5 or pHs of less than 5. In some embodiments of the foregoing, the reference methionine gamma lyase polypeptide is the reference sequence of SEQ ID NO: 2.

In some embodiments, the recombinant methionine gamma lyase exhibits at least one improved property selected from: i) enhanced catalytic activity; ii) increased tolerance to acid pH; iii) increased tolerance to pH 5.2 or less; iv) increased tolerance to at least one protease; v) increased tolerance to at least one gastrointestinal protease; vi) increased tolerance to at least one bile salt; vii) increased thermotolerance; or a combination of any of i), ii), iii), iv), v), vi), vi), and vii) as compared to a reference methionine gamma lyase polypeptide. In some embodiments, the reference methionine gamma lyase polypeptide is sequence of SEQ ID NO: 2. In some alternative embodiments, the reference methionine gamma lyase polypeptide is a sequence selected from SEQ ID NO: 94, 248, 352, 478, 832, 916, 1172, 1232, 1346, and/or 1488. In some additional embodiments of the foregoing, the increased tolerance to pH is at pH 5.2. In some additional embodiments of the foregoing, the increased tolerance to pH is at pH 5. In some embodiments, the recombinant methionine gamma lyase exhibits at least two or at least three improved properties selected from: i) enhanced catalytic activity; ii) increased tolerance to acid pH; iii) increased tolerance to pH 5.2; iv) increased tolerance to at least one protease; v) increased tolerance to at least one gastrointestinal protease; vi) increased tolerance to at least one bile salt; vii) increased thermotolerance; or a combination of any of i), ii), iii), iv), v), vi), and vii) as compared to at least two or more reference methionine gamma lyase polypeptide. In some embodiments, the reference methionine gamma lyase polypeptide is a sequence selected from SEQ ID NOS: 2, 94, 248, 352, 478, 832, 916, 1172, 1232, 1346, and/or 1488.

In some embodiments, the recombinant methionine gamma lyase polypeptide is in purified form.

In another aspect, the present invention also provides recombinant polynucleotide sequences encoding at least one recombinant methionine gamma lyase provided herein. In some embodiments, the recombinant polynucleotide sequence encoding at least one recombinant methionine gamma lyase provided herein is codon-optimized. In some embodiments, the recombinant polynucleotide comprises a sequence having at least about 70%, 75%, 80% 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequence of SEQ ID NOS: 1-1733, wherein the polynucleotide encodes a recombinant methionine gamma lyase. In some embodiments, the polynucleotide comprises a sequence having at least 80%, 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 1-1733, wherein the polynucleotide encodes a recombinant methionine gamma lyase. In some embodiments, the present invention provides at least one polynucleotide sequence set forth in the odd-numbered sequences of SEQ ID NOS: 1-1733. In some additional embodiments, the recombinant polynucleotide sequence comprises a sequence selected from the odd-numbered sequences of SEQ ID NOS: 1-1733. In some embodiments, the recombinant polynucleotide sequence comprises a sequence selected from the odd-numbered sequences of SEQ ID NOS: 1-1733, wherein the sequence encodes a recombinant methionine gamma lyase polypeptide provided herein. In some embodiments, the recombinant polynucleotide sequence comprises a sequence selected from the odd-numbered sequences of SEQ ID NOS: 1-1733, wherein the sequence encodes a recombinant polypeptide provided in an even-numbered sequence provided in SEQ ID NOS: 2-1734 or SEQ ID NOS: 4-1734. In some embodiments, the recombinant polynucleotide encoding a recombinant methionine gamma lyase provided herein comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 1-1733. In some embodiments, the recombinant polynucleotide encoding a recombinant methionine gamma lyase provided herein comprises a sequence having at least 80%, 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 1-1733. In some embodiments, the recombinant polynucleotide encoding a recombinant methionine gamma lyase provided herein comprises a sequence having at least 80%, 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 1-1733, wherein the recombinant methionine gamma lyase comprises a polypeptide sequence comprising an even-numbered sequence provided in SEQ ID NOS: 2-1734.

In another aspect, the present invention also provides expression vectors comprising at least one recombinant polynucleotide sequence provided herein. The present invention also provides expression vectors comprising at least one recombinant polynucleotide sequence encoding at least one recombinant methionine gamma lyase provided herein. In some additional embodiments, the recombinant polynucleotide sequence is operably linked to a control sequence. In some embodiments, the control sequence is a promoter. In some further embodiments, the promoter is a heterologous promoter.

In a further aspect, the present invention also provides host cells comprising at least one expression vector provided herein. The present invention also provides host cells comprising at least one expression vector comprising at least one recombinant polynucleotide sequence encoding at least one recombinant methionine gamma lyase provided herein. The present invention also provides host cells comprising an expression vector comprising at least one recombinant polynucleotide sequence encoding at least one recombinant methionine gamma lyase provided herein. The present invention also provides host cells comprising an expression vector comprising at least one recombinant polynucleotide sequence encoding a recombinant methionine gamma lyase provided herein. In some embodiments, the host cell is eukaryotic, while in some alternative embodiments, the host cell is prokaryotic. In some embodiments, the host cell is *Escherichia coli*. In some alternative embodiments, the host cell is *Saccharomyces cerevisiae*.

The present invention also provides methods of producing at least one recombinant methionine gamma lyase, comprising culturing at least one host cell provided herein, under suitable conditions such that the recombinant methionine gamma lyase encoded by the recombinant polynucleotide is produced. In some embodiments, the methods further comprise the step of recovering the methionine gamma lyase. In yet some additional embodiments, the methods further comprise the step of purifying the methionine gamma lyase.

In another aspect, the present invention also provides compositions comprising at least one recombinant methionine gamma lyase provided herein. In some embodiments, the composition comprising at least one recombinant methionine gamma lyase comprises a pharmaceutical composition. In some additional embodiments, the pharmaceutical composition is suitable for the treatment of homocystinuria. In some additional embodiments, the pharmaceutical composition further comprising a pharmaceutically acceptable carrier and/or excipient. In some embodiments, the pharmaceutical composition is suitable for parenteral injection or infusion to a human. The present invention also provides compositions comprising at least one recombinant methionine gamma lyase provided herein, wherein the compositions are suitable for other uses.

The present invention also provides methods for treating and/or preventing the symptoms of homocystinuria in a subject, comprising providing to a subject having homocystinuria a recombinant methionine gamma lyase. In some embodiments, a method of treating a subject with homocystinuria comprises administering to a subject in need thereof an effective amount of a recombinant methionine gamma lyase described herein. In some embodiments, an effective amount is a dose that results in reduction in levels of plasma methionine, homocysteine, and/or homocysteine-cysteine complex. In some embodiments, administering an effective amount of recombinant methionine gamma lyase described herein results in greater than 5%, greater than 25%, or greater than 50% reduction in levels of plasma methionine and/or homocysteine. In some embodiments, the symptoms of homocystinuria are ameliorated in a subject upon administration of a recombinant methionine gamma lyase to the subject.

In some embodiments, the recombinant methionine gamma lyase described herein is administered to the subject administered immediately before, concurrently with, or immediately following ingestion of a protein meal containing methionine.

In some embodiments, the subject with homocystinuria is administered a recombinant methionine gamma lyase described herein at a dose of about 1 mg/kg to about 500 mg/kg. In some embodiments, the subject with homocystinuria is administered a recombinant methionine gamma lyase described herein at a dose of about 1 mg/kg to about 400 mg/kg. In some embodiments, the subject is administered a dose of about 1 mg/kg to about 200 mg/kg. In some embodiments, the subject is administered a dose of about 5 mg/kg to about 200 mg/kg.

In some embodiments, the subject is able to eat a diet that is less restricted in its methionine content than diets required by subjects exhibiting the symptoms of homocystinuria. In some embodiments, the subject is able to eat a diet that is less restricted in protein content than diets required by subjects exhibiting the symptoms of homocystinuria. In some embodiments, the subject is able to eat a diet that is less restricted in its lipid content than diets required by subjects exhibiting the symptoms of homocystinuria.

In some embodiments, the subject is an infant, while in some other embodiments, the subject is a child. In yet some other embodiments, the subject is an adult, while in some alternative embodiments, the subject is a young adult.

In a further aspect, the present invention also provides for use of the compositions comprising at least one recombinant methionine gamma lyase provided herein.

BRIEF DESCRIPTION OF THE DRAWINGS

FIG. 1A shows measured serum HCy levels. Data is represented as mean SEM; Unpaired t-test, LMD v. Whey Challenge: , p0.01; , p<0.0001; Unpaired t-test, Control v. Treated: ^, p<0.05; ^^, p<0.01. FIG. 1B shows measured serum Met levels. Data is represented as mean±SEM; Unpaired t-test, LMD v. Whey Challenge: **, p<0.0001; Unpaired t-test, Control v. Treated: p<0.01.

FIG. 2A shows measured homocysteine levels. Data is represented as mean±SEM; One way ANOVA vs Control *, p<0.05; *, p<0.001; **, p<0.0001. FIG. 2B shows measured serum methionine levels. Data is represented as mean±SEM; One way ANOVA vs Control. Treatment with engineered methionine gamma lyase of SEQ ID NO: 1706 suppressed homocysteine (HCy) spike at 4 hrs in a dose dependent manner. A non-significant trend toward suppression of methionine (Met) was observed at 4 hrs.

DESCRIPTION OF THE INVENTION

Figure 1A:
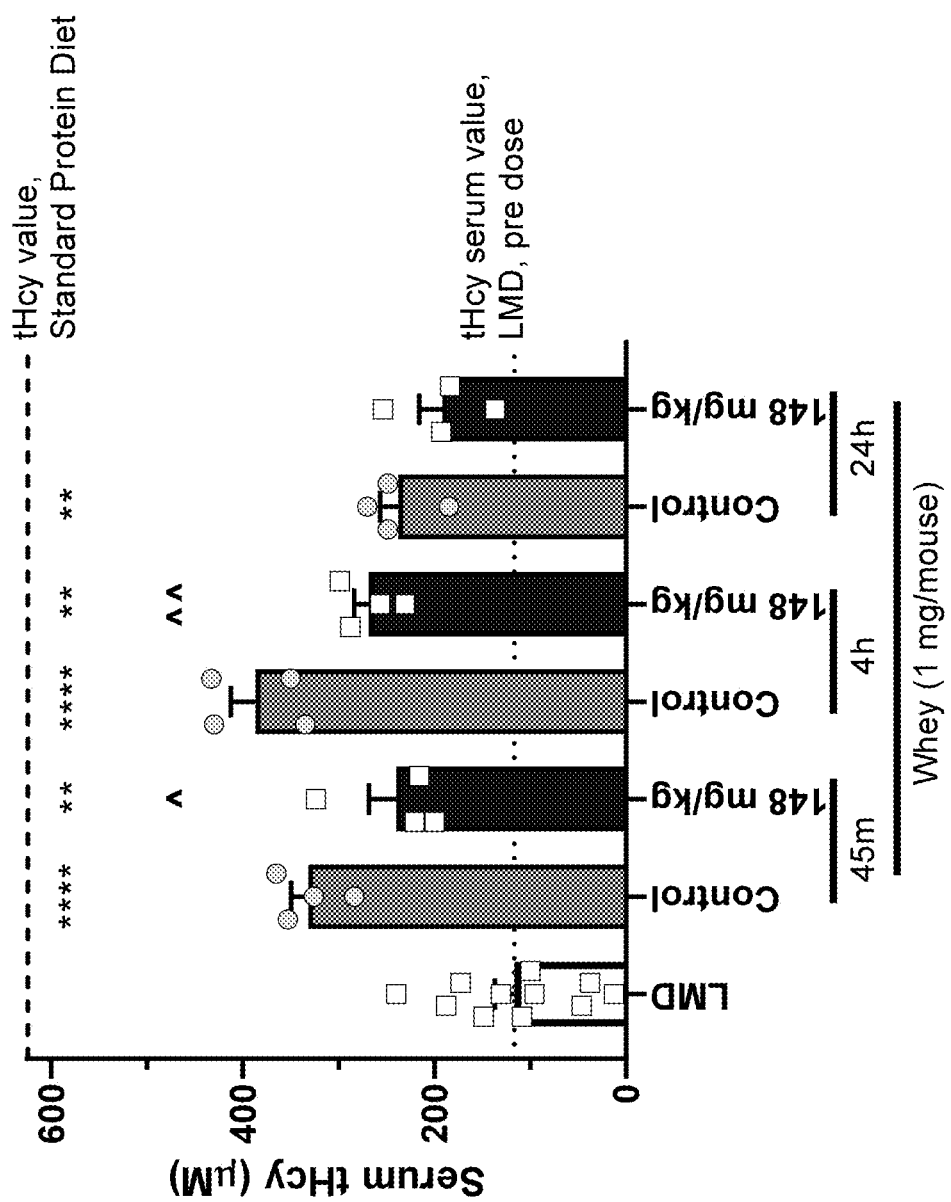
FIGS. 1A and 1B shows the results of pharmacodynamic (PD) study of engineered methionine gamma lyase of SEQ ID NO: 1706 in Tg-1278T Cbs−/− Mouse Model. The study results show the suppression of serum homocysteine (HCy) and methionine (Met) by engineered methionine gamma lyase of SEQ ID NO: 1706 following a whey protein meal.

The present invention provides engineered methionine gamma lyase polypeptides and compositions thereof. The engineered methionine gamma lyase polypeptides have been optimized to provide improved thermostability, protease stability, and stability under a range of pH conditions, including acidic (pH<7) conditions. The invention also relates to the use of the engineered methionine gamma lyase polypeptides for therapeutic purposes. In some embodiments, the methionine gamma lyase variants of the present invention find use in treatment of homocystinuria. In some additional embodiments, the methionine gamma lyase is administered in formats that do not require an enteric coating and/or proton-pump inhibitors (PPIs).

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, biochemistry, organic chemistry, analytical chemistry, and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

As used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances, "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein "ATCC" refers to the American Type Culture Collection whose biorepository collection includes genes and strains.

As used herein "NCBJ" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

"Methionine gamma lyase" or "methionine gamma lyase polypeptide" refers to an enzyme that converts methionine to α-ketobutyrate. In some embodiments, additional products ammonia and methyl mercaptan are generated in the conversion of methionine to α-ketobutyrate. In some embodiments, "recombinant methionine gamma lyase polypeptides" (also referred to herein as "engineered methionine gamma lyase polypeptides," "variant methionine gamma lyase enzymes," and "methionine gamma lyase variants") are methionine gamma lyases made using recombinant techniques.

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

Recombinant polypeptides can be produced using any suitable methods known the art. Genes encoding the wild-type polypeptide of interest can be cloned in vectors, such as plasmids, and expressed in desired hosts, such as E. coli, S. cerevisiae, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.).

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

As used herein, "coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

As used herein, "reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. "Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered methionine gamma lyase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position 6 as compared to SEQ ID NO: 2" refers to a difference of the amino acid residue at the polypeptide position corresponding to position 6 of SEQ ID NO: 2. Thus, if the reference polypeptide of SEQ ID NO: 2 has a asparagine at position 6, then a "residue difference at position X6 as compared to SEQ ID NO:2" means there is an amino acid residue other than asparagine at the position of the polypeptide corresponding to position 6 of SEQ ID NO: 6 (e.g., N6S). In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Table 3-1, 3-2, 3-3, 3-4, 3-5, 3-6, 3-7, 3-8, 3-9, 3-10, 3-11, and/or 3-12), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X2S/X2T or X2S/T or R2S/T). In some embodiments, the enzyme variants comprise more than one substitution. These substitutions are separated by a slash for ease in reading (e.g., N6S/G25E/G55P). The present application includes engineered polypeptide sequences comprising one or more amino acid differences that include either/or both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" and a "biologically active fragment" are used interchangeably herein and refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered methionine gamma lyase of the present invention) and that retains substantially all of the activity of the full-length polypeptide. In some embodiments, substantially all of the activity of the full-length polypeptide refers to at least 90% activity of the recombinant polypeptide from which it was derived.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant methionine gamma lyase polypeptides may be present within a cell, present in the cellular medium, or prepared in various forms, such as lysates or isolated preparations. As such, in some embodiments, the recombinant methionine gamma lyase polypeptides can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure methionine gamma lyase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant methionine gamma lyase polypeptides are substantially pure polypeptide compositions.

As used herein, "improved enzyme property" in the context of an engineered methionine gamma lyase polypeptide refers to an improvement in any enzyme property as compared to a reference methionine gamma lyase polypeptide and/or as a wild-type methionine gamma lyase polypeptide or another engineered methionine gamma lyase polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic or basic pH, increased tolerance to proteolytic activity (i.e., reduced sensitivity to proteolysis), reduced aggregation, increased solubility, reduced immunogenicity, improved post-translational modification (e.g., glycosylation), and altered temperature profile.

As used herein, "increased enzymatic activity" or "enhanced catalytic activity" refers to an improved property of the engineered methionine gamma lyase polypeptides, which can be represented by an increase in specific activity (e.g., product produced/time/weight protein) or an increase in percent conversion of the substrate to the product (e.g., percent conversion of starting amount of substrate to product in a specified time period using a specified amount of methionine gamma lyase) as compared to the reference methionine gamma lyase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring methionine gamma lyase or another engineered methionine gamma lyase from which the methionine gamma lyase polypeptides were derived.

Methionine gamma lyase activity can be measured by any suitable method known in the art (e.g., standard assays, such as monitoring changes in spectrophotometric properties of reactants or products). In some embodiments, the amount of products produced can be measured by High-Performance Liquid Chromatography (HPLC) separation combined with UV absorbance In some embodiments, the amount of products produced can be measured using a RAPIDFIRE® mass spectrometer, while in some other embodiments, the products can be measured using alternative methods known in the art. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

As used herein, the terms "protease stable" and "stability to proteolysis" refer to the ability of a protein (e.g., a recombinant methionine gamma lyase of the present invention) to function and withstand proteolysis mediated by any proteolytic enzyme or other proteolytic compound or factor. It is not intended that the term be limited to the use of any particular protease to assess the stability of a protein. Indeed, the engineered methionine gamma lyases of the present invention are stable and retain enzymatic activity in the presence of various proteases. In some embodiments, the engineered methionine gamma lyases are stable in the presence of trypsin, chymotrypsin, and/or pepsin. However, it is not intended that the present invention be limited to any specific protease or any particular method of assessing proteolytic stability.

As used herein, the term "pH stability" refers to the ability of a protein (e.g., a recombinant methionine gamma lyase of the present invention) to function after incubation at a particular pH. In some embodiments, the present invention provides recombinant methionine gamma lyases that are stable at a range of pHs, including, but not limited to the range of pH 2 to pH 7. In some embodiments, the recombinant methionine gamma lyases are stable at different pH ranges, as indicated in the Examples provided herein. It is not intended that the present invention be limited to any pH stability level nor pH range.

As used herein, the term "improved tolerance to acidic pH" means that a recombinant methionine gamma lyase according to the invention will have increased stability (higher retained activity at about pH 7, 6, 5, 4 3, 2, or even lower, after exposure to acidic pH for a specified period of time [e.g., 1 hour, up to 24 hours, etc.]) as compared to a reference methionine gamma lyase or another enzyme.

"Physiological pH" as used herein means the pH range generally found in a subject's (e.g., human) blood.

The term "basic pH" (e.g., used with reference to improved stability to basic pH conditions or increased tolerance to basic pH) means a pH range of about 7 to 11.

The term "acidic pH" (e.g., used with reference to improved stability to acidic pH conditions or increased tolerance to acidic pH) means a pH range that encompasses any pH values less than 7. In some embodiments, the acid pH is less than 7, while in some other embodiments, the pH is less than about 6, 5, 4, 3, 2, or lower. In some embodiments, the pH is 5.2. In some alternative embodiments, the recombinant methionine gamma lyases of the present invention are stable at pH levels of 2 to 4. However, it is not intended that the present invention be limited to any specific pH value or range of values.

The term "thermal stability" refers to the ability of a protein (e.g., a recombinant methionine gamma lyase of the present invention) to function at a particular temperature. Thermal stability can be measured by any method known in the art (e.g., the methods described herein). It is not intended that the present invention be limited to any specific temperature stability level nor temperature range.

The term "chemical stability" refers to the ability of a protein (e.g., a recombinant methionine gamma lyase of the present invention) to function in the presence of a chemical that adversely affects the function of another protein. It is not intended that the present invention be limited to any specific chemical stability level nor range of chemical stabilities.

"Conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a methionine gamma lyase polypeptide can be expressed as "percent conversion" of the substrate to the product in a specific period of time.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above. In some embodiments, a polynucleotide encoding a methionine gamma lyase hybridizes under high stringency conditions to an engineered polynucleotide disclosed herein encoding an engineered methionine gamma lyase.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, "codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the methionine gamma lyase enzymes may be codon optimized for optimal production from the host organism selected for expression.

As used herein, "control sequence" refers herein to include all components, which are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

As used herein, "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

As used herein, the phrase "suitable reaction conditions" refers to those conditions in the enzymatic conversion reaction solution (e.g., ranges of enzyme loading, substrate loading, temperature, pH, buffers, co-solvents, etc.) under which a methionine gamma lyase polypeptide of the present application is capable of converting a substrate to the desired product compound. Exemplary "suitable reaction conditions" are provided in the present application and illustrated by the Examples. "Loading", such as in "compound loading" or "enzyme loading" refers to the concentration or amount of a component in a reaction mixture at the start of the reaction. "Substrate" in the context of an enzymatic conversion reaction process refers to the compound or molecule acted on by the methionine gamma lyase polypeptide. "Product" in the context of an enzymatic conversion process refers to the compound or molecule resulting from the action of the methionine gamma lyase polypeptide on a substrate.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the methionine gamma lyase variants). In some embodiments, the host cells are prokaryotic or eukaryotic cells that have been transformed or transfected with vectors constructed using recombinant DNA techniques as known in the art.

As used herein, the term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, the term refers to polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

As used herein, the term "culturing" refers to the growing of a population of microbial cells under any suitable conditions (e.g., using a liquid, gel, or solid medium).

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered methionine gamma lyase polypeptide encompassed by the invention and an acceptable carrier.

The term "effective amount" means an amount sufficient to produce the desired result. One of general skill in the art may determine what the effective amount in view of the guidance in the specification.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the 28$^{th}$ day of life.

The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered methionine gamma lyase of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of homocystinuria).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered methionine gamma lyase polypeptides of the present invention). Excipients are typically included for formulation and/or administration purposes.

The term "therapeutically effective amount" when used in reference to symptoms of disease/condition refers to the amount and/or concentration of a compound (e.g., engineered methionine gamma lyase polypeptides) that ameliorates, attenuates, or eliminates one or more symptom of a disease/condition or prevents or delays the onset of symptom(s).

The term "therapeutically effective amount" when used in reference to a disease/condition refers to the amount and/or concentration of a composition (e.g., engineered methionine gamma lyase polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

It is intended that the terms "treating," "treat" and "treatment" encompass preventative (e.g., prophylactic), as well as palliative treatment.

Engineered Methionine Gamma Lyase:

The present invention provides engineered methionine gamma lyases suitable for various uses, including treatment of pancreatic enzyme insufficiency. In some embodiments the engineered methionine gamma lyase which exhibits an improved property has at least about 70%, at least about 75%, at least about 80%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, 94, 248, 352, 478, 832, 916, 1172, 1232, 1346, and/or 1488, and an amino acid residue difference as compared to SEQ ID NO: 2, 94, 248, 352, 478, 832, 916, 1172, 1232, 1346, and/or 1488, at one or more amino acid positions (such as at 1, 2, 3, 4, 5, 6, 7, 8, 9, 10, 11, 12, 14, 15, 20 or more amino acid positions compared to SEQ ID NO: 2, 94, 248, 352, 478, 832, 916, 1172, 1232, 1346, and/or 1488, or a sequence having at least at least 70, at least 75, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% or greater amino acid sequence identity with SEQ ID NO: 2, 94, 248, 352, 478, 832, 916, 1172, 1232, 1346, and/or 1488. In some embodiment the residue difference as compared to SEQ ID NO: 2, 94, 248, 352, 478, 832, 916, 1172, 1232, 1346, and/or 1488, at one or more positions include at least 1, 2, 3, 4, 5, 6, 7, 8, 9, 10 or more conservative amino acid substitutions. In some embodiments, the engineered methionine gamma lyase polypeptide is a polypeptide listed in Table 3-1, 3-2, 3-3, 3-4, 3-5, 3-6, 3-7, 3-8, 3-9, 3-10, 3-11, and/or Table 3-12. In some embodiments, the engineered methionine gamma lyase polypeptide comprises SEQ ID NO: 2, 94, 248, 352, 478, 832, 916, 1172, 1232, 1346, 1488, or 1706.

In some embodiments, the recombinant methionine gamma lyases and/or biologically active recombinant methionine gamma lyase fragments comprises a polypeptide sequence comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the recombinant methionine gamma lyase and/or biologically active recombinant methionine gamma lyase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2.

In some embodiments, the recombinant methionine gamma lyases and/or biologically active recombinant methionine gamma lyase fragments comprise a polypeptide sequence having at least one substitution or substitution set at one or more positions: 2, 3, 4, 5, 6, 7, 8, 9, 11, 17, 21, 23, 25, 27, 29, 30, 31, 32, 33, 34, 35, 36, 38, 41, 43, 46, 47, 47, 48, 49, 50, 51, 53, 54, 55, 57, 58, 60, 62, 63, 66, 67, 68, 69, 82, 83, 87, 91, 99, 102, 111, 112, 113, 119, 124, 126, 127, 128, 132, 134, 138, 140, 141, 142, 144, 145, 146, 149, 150, 152, 154, 155, 156, 158, 160, 165, 167, 170, 173, 174, 175, 176, 177, 178, 179, 180, 181, 183, 189, 190, 193, 195, 199, 199, 206, 209, 214, 219, 220, 221, 223, 225, 228, 229, 230, 231, 232, 233, 236, 237, 239, 240, 242, 243, 245, 247, 250, 251, 252, 253, 254, 255, 256, 259, 263, 267, 269, 270, 271, 272, 275, 276, 278, 279, 281, 282, 283, 284, 287, 288, 290, 295, 296, 298, 300, 301, 304, 308, 309, 312, 314, 315, 316, 317, 322, 323, 324, 325, 327, 333, 334, 335, 336, 338, 341, 344, 348, 353, 357, 358, 361, 362, 364, 365, 366, 367, 368, 383, 384, 386, 388, 390, 391, 392, 394, 395, 396, 398, or combinations thereof, wherein the amino acid positions are relative to the reference sequence of SEQ ID NO: 2. In some embodiments, the recombinant methionine gamma lyases and/or biologically active recombinant methionine gamma lyase fragments comprises polypeptide sequences having at least one substitution or substitution set of substitutions: 2K/S/T/W, 3A/E/P/S, 4E/G/R/V, 5G/H/I/K/P/T, 6L/P/R/S, 7E/F/G/L/S/V, 8G/P/R/S/Y, 9A/R, 11S/A/C/G/H/M/R, 17C, 21A, 23S/K, 25E, 27S, 29T, 30N, 31A, 32N, 33A/T, 34L, 35G/S, 36S, 38F, 41E, 43A, 46Q, 47G, 47Q, 48M/R, 49A/T, 50L/M/V, 51K/N/S, 53L, 54I/Q/R, 55E/H/K/P/A/N, 57Y/H, 58T, 60T, 62A/C/H, 63G, 66Q/S, 67A/Q/R/V, 68D/G, 69R/V/I/W, 82C, 83S, 87G, 91S/L, 99A, 102A, 111H, 112A, 113M/T, 119T, 124A/H/R/S/V, 126A/E/R/S, 127A/K/Q/V, 128H, 132V, 134F, 138C/S/T, 140T, 141Q/V/E/G/P/R/S/T, 142L/S, 144R, 145G/S, 146S, 149D/T, 150T, 152A, 154V, 155F, 156L, 158S, 160M, 165R, 167T, 170G/P/Q/W, 173V/A, 174E, 175V, 176V, 177T, 178A, 179A/S/W, 180G/V, 181I, 183V, 189I/M/P/S/Y/L, 190A/G/L, 193S, 195S/T, 199T, 199W, 206I, 209G, 214C, 219L/V/I, 220I/V, 221G, 223L/I, 225C, 228A/R, 229G/H/S, 230V, 231V, 232P, 233G/M/Q/S/V, 236A/C/R/Y, 237A/G/H/K/L/R/T/V/Y, 239C/K/T/V/Y, 240D/G/P/R, 242F, 243C/G/S, 245G/S, 247M, 250F/S, 251A/N, 252C, 253G/M, 254A, 255V, 256L/V, 259L, 263G/K/P/Q/S/A, 267N/E/R/T, 269S, 270S, 271D, 272S, 275A/H/N/R/S, 276V/I/L, 278C, 279H/F/W, 281V, 282A/N/Q/V, 283N/Q/H, 284A/E/S/V, 287D/V, 288A/G/I/K/M/Q/R/S/T/W, 290N/Q/V/A/K, 295G/S/E, 296G/N, 298G/K/P/S/V/C/G/N/R/Y, 300R, 301D/E/G/K/N/Q/S, 304R/K/V, 308A/K/L/S, 309A/K, 312A, 314L, 315S, 316L, 317R, 322A/E/

K/Q/V, 323K/S/T, 324S, 325A, 327M, 333F/S/T, 334V/L, 335I, 336H, 338G, 341F, 344C/T/V/A/G/R/S, 348V, 353T, 357A/G, 358C/K/L/R/T, 361V, 362R/E, 364L, 365K/R, 366Q/R/E, 367A, 368G/D, 383I, 384A/G/Q/S, 386I, 388R, 390L, 391N/E, 392H, 394P, 395A/D/H/R, 396Q/R/V, 398G/ P/Q, or combinations thereof, wherein the amino acid positions are relative to the reference sequence of SEQ ID NO: 2. In some embodiments, the recombinant methionine gamma lyases and/or biologically active recombinant methionine gamma lyase fragments comprises polypeptide sequences having at least one substitution or substitution set of substitutions: R2K/S/T/W, D3A/E/P/S, 4E/G/R/V, N5G/ H/I/K/P/T, 6L/P/R/S, N7E/F/G/L/S/V, 8G/P/R/S/Y, 9A/R, 11S/A/C/G/H/M/R, 17C, 21A, 23S/K, 25E, 27S, 29T, 30N, 31A, 32N, 33A/T, 34L, 35G/S, 36S, 38F, 41E, 43A, 46Q, 47G, 47Q, 48M/R, 49A/T, 50L/M/V, 51K/N/S, 53L, 54I/Q/ R, 55E/H/K/P/A/N, 57Y/H, 58T, 60T, 62A/C/H, 63G, 66Q/ S, 67A/Q/R/V, 68D/G, 69R/V/I/W, 82C, 83S, 87G, 91S/L, 99A, 102A, 111H, 112A, 113M/T, 119T, 124A/H/R/S/V, 126A/E/R/S, 127A/K/Q/V, 128H, 132V, 134F, 138C/S/T, 140T, 141Q/V/E/G/P/R/S/T, 142L/S, 144R, 145G/S, 146S, 149D/T, 150T, 152A, 154V, 155F, 156L, 158S, 160M, 165R, 167T, 170G/P/Q/W, 173V/A, 174E, 175V, 176V, 177T, 178A, 179A/S/W, 180G/V, 181I, 183V, L189I/M/P/S/Y, C190A/G/L, Y193S, Q195S/T, E199T, F199W, V206I, A209G, S214C, I219L/V, T220I/V, A221G, I223L, V225C, K228A/R, A229G/H/S, L230V, I231V, D232P, R233G/M/ Q/S/V, L236A/C/R/Y, E237A/G/H/K/L/R/T/V/Y, L239C/K/ T/V/Y, K240D/G/P/R, M242F, T243C/G/S, A245G/S, L247M, H250F/S, D251A/N, A252C, S253G/M, L254A, L255V, M256L/V, I259L, A263G/K/P/Q/S, D267N/E/R/T, H269S, C270S, A271D, N272S, Q275A/H/N/R/S, I276V/L, E278C, F279H/W, A281V, R282A/N/Q/V, H283N/Q, P284A/E/S/V, E287D/V, L288A/G/I/K/M/Q/R/S/T/W, A290N/Q/V/K, P295G/S/E, S296G/N, S298G/K/P/V/C/G/ N/R/Y, Y300R, A301D/E/G/K/N/Q/S, Q304R/K/V, R308A/ K/L/S, L309A/K, G312A, I314L, A315S, F316L, E317R, I322A/E/K/Q/V, E323K/S/T, A324S, G325A, R327M, Q333F/S/T, L334V, F335I, S336H, A338G, L341F, A344C/ T/V/G/R/S, A348V, S353T, S357A/G, S358C/K/L/R/T, P361V, Q362R/E, R364L, A365K/R, H366Q/R/E, H367A, D368G, V383I, D384A/G/Q/S, L386I, A388R, I390L, D391N/E, Q392H, L394P, K395A/D/H/R, A396Q/R/V, A398G/P/Q, or combinations thereof, wherein the amino acid positions are relative to the reference sequence of SEQ ID NO: 2.

In some embodiments, the recombinant methionine gamma lyases and/or biologically active recombinant methionine gamma lyase fragments comprises polypeptide sequences having at least one substitution or substitution set at amino acid positions: 8, 11, 23, 55, 57, 69, 141, 165, 173, 189, 219, 223, 236, 237, 263, 267, 276, 279, 283, 290, 298, 304, 334, 341, 344, 366, 368, or combinations thereof, wherein the amino acid positions are relative to the reference sequence of SEQ ID NO: 2. In some embodiments, the recombinant methionine gamma lyases and/or biologically active recombinant methionine gamma lyase fragments comprises polypeptide sequences having at least one substitution or substitution set of substitutions: 8S, 11M, 23K, 55K/S, 57Y, 69I, 141E, 165R, 173V, 189L, 219VL, 223I, 236R, 237K, 263G, 267E, 276I, 279F, 283H, 290A/Q, 298S, 304R, 334L, 341F, 344A, 366E, 368D, or combinations thereof, wherein the amino acid positions are relative to the reference sequence of SEQ ID NO: 2. In some embodiments, the recombinant methionine gamma lyases and/or biologically active recombinant methionine gamma lyase fragments comprises polypeptide sequences having at least one substitution or substitution set of substitutions: T8S, S11M, S23K, G55K/S, H57Y, L69I, Q141E, Q165R, A173V, Y189L, I219VL, L223I, L236R, E237K, A263G, D267E, V276I, H279F, Q283H, N290A/Q, A298S, Q304R, V334L, L341F, T344A, H366E, G368D, or combinations thereof, wherein the amino acid positions are relative to the reference sequence of SEQ ID NO: 2.

In some embodiments, the recombinant methionine gamma lyases and/or biologically active recombinant methionine gamma lyase fragments comprises polypeptide sequences having at least one substitution or substitution set at amino acid positions selected from: 69, 290, and 344. In some embodiments, the recombinant methionine gamma lyases and/or biologically active recombinant methionine gamma lyase fragments comprises polypeptide sequences having at least one substitution or substitution set at amino acid positions selected from: 55, 304, and 366. In some embodiments, the recombinant methionine gamma lyases and/or biologically active recombinant methionine gamma lyase fragments comprises polypeptide sequences having at least one substitution or substitution set at amino acid positions selected from: 165, 173, 189, and 283. In some embodiments, the recombinant methionine gamma lyases and/or biologically active recombinant methionine gamma lyase fragments comprises polypeptide sequences having at least one substitution at amino acid position 11. In some embodiments, the recombinant methionine gamma lyases and/or biologically active recombinant methionine gamma lyase fragments comprises polypeptide sequences having at least one substitution or substitution set at amino acid positions selected from: 290, 334, and 368. In some embodiments, the recombinant methionine gamma lyases and/or biologically active recombinant methionine gamma lyase fragments comprises polypeptide sequences having at least one substitution or substitution set at amino acid positions selected from: 219, 263, and 334. In some embodiments, the recombinant methionine gamma lyases and/or biologically active recombinant methionine gamma lyase fragments comprises polypeptide sequences having at least one substitution or substitution set at amino acid positions selected from: 57, 141, and 344. In some embodiments, the recombinant methionine gamma lyases and/or biologically active recombinant methionine gamma lyase fragments comprises polypeptide sequences having at least one substitution or substitution set at amino acid positions selected from: 23, 219, 276, and 341. In some embodiments, the recombinant methionine gamma lyases and/or biologically active recombinant methionine gamma lyase fragments comprises polypeptide sequences having at least one substitution or substitution set at amino acid positions selected from: 223, 279, and 298. In some embodiments, the recombinant methionine gamma lyases and/or biologically active recombinant methionine gamma lyase fragments comprises polypeptide sequences having at least one substitution or substitution set at amino acid positions selected from: 8, 55, 236, 237, and 267. In some embodiments, for the foregoing amino acid positions, the substitution is selected from the following: 8S, 11M, 23K, 55K/S, 57Y, 69I, 141E, 165R, 173V, 189L, 219VL, 223I, 236R, 237K, 263G, 267E, 276I, 279F, 283H, 290A/Q, 298S, 304R, 334L, 341F, 344A, 366E, and 368D, wherein the amino acid positions are relative to the reference sequence of SEQ ID NO: 2.

In some embodiments, the recombinant methionine gamma lyases and/or biologically active recombinant methionine gamma lyase fragments comprises polypeptide sequences having at least substitutions at amino acid positions: 69, 290, and 344. In some embodiments, the recombinant methionine gamma lyases and/or biologically active recombinant methionine gamma lyase fragments comprises polypeptide sequences having at least amino acid residues: 69I, 290A, and 344T. In some embodiments, the recombinant methionine gamma lyases and/or biologically active recombinant methionine gamma lyase fragments comprises polypeptide sequences having at least substitutions at amino acid positions: 55, 69, 290, 304, 344, and 366. In some embodiments, the recombinant methionine gamma lyases and/or biologically active recombinant methionine gamma lyase fragments comprises polypeptide sequences having at least amino acid residues: 55K, 69I, 290A, 304R, 344T, and 366E. In some embodiments, the recombinant methionine gamma lyases and/or biologically active recombinant methionine gamma lyase fragments comprises polypeptide sequences having at least substitutions at amino acid positions: 55, 69, 165, 173, 189, 283, 290, 304, 344, and 366. In some embodiments, the recombinant methionine gamma lyases and/or biologically active recombinant methionine gamma lyase fragments comprises polypeptide sequences having at least amino acid residues: 55K, 69I, 165R, 173V, 189L, 283H, 290A, 304R, 344T, and 366E. In some embodiments, the recombinant methionine gamma lyases and/or biologically active recombinant methionine gamma lyase fragments comprises polypeptide sequences having at least substitutions at amino acid positions: 11, 55, 69, 165, 173, 189, 283, 290, 304, 344, and 366. In some embodiments, the recombinant methionine gamma lyases and/or biologically active recombinant methionine gamma lyase fragments comprises polypeptide sequences having at least amino acid residues: 11M, 55K, 69I, 165R, 173V, 189L, 283H, 290A, 304R, 344T, and 366E. In some embodiments, the recombinant methionine gamma lyases and/or biologically active recombinant methionine gamma lyase fragments comprises polypeptide sequences having at least substitutions at amino acid positions: 11, 55, 69, 165, 173, 189, 219, 263, 283, 290, 304, 334, 344, 366, and 368. In some embodiments, the recombinant methionine gamma lyases and/or biologically active recombinant methionine gamma lyase fragments comprises polypeptide sequences having at least amino acid residues: 11M, 55K, 69I, 165R, 173V, 189L, 219V, 263G, 283H, 290A/Q, 304R, 334V, 344T, 366E, and 368D. In some embodiments, the recombinant methionine gamma lyases and/or biologically active recombinant methionine gamma lyase fragments comprises polypeptide sequences having at least substitutions at amino acid positions: 11, 55, 57, 69, 141, 165, 173, 189, 219, 263, 283, 290, 304, 334, 344, 366, and 368. In some embodiments, the recombinant methionine gamma lyases and/or biologically active recombinant methionine gamma lyase fragments comprises polypeptide sequences having at least amino acid residues: 11M, 55K, 57Y, 69I, 141E, 165R, 173V, 189L, 219V, 263G, 283H, 290A/Q, 304R, 334V, 344T, 366E, and 368D. In some embodiments, the recombinant methionine gamma lyases and/or biologically active recombinant methionine gamma lyase fragments comprises polypeptide sequences having at least substitutions at amino acid positions: 11, 23, 55, 57, 69, 141, 165, 173, 189, 219, 263, 276, 283, 290, 304, 334, 341, 344, 366, and 368. In some embodiments, the recombinant methionine gamma lyases and/or biologically active recombinant methionine gamma lyase fragments comprises polypeptide sequences having at least amino acid residues: 11M, 23K, 55K, 57Y, 69I, 141E, 165R, 173V, 189L, 219V/L, 263G, 276I, 283H, 290A/Q, 304R, 334V, 341F, 344T, 366E, and 368D. In some embodiments, the recombinant methionine gamma lyases and/or biologically active recombinant methionine gamma lyase fragments comprises polypeptide sequences having at least substitutions at amino acid positions: 11, 23, 55, 57, 69, 141, 165, 173, 189, 219, 223, 263, 276, 279, 283, 290, 298, 304, 334, 341, 344, 366, and 368. In some embodiments, the recombinant methionine gamma lyases and/or biologically active recombinant methionine gamma lyase fragments comprises polypeptide sequences having at least amino acid residues: 11M, 23K, 55K, 57Y, 69I, 141E, 165R, 173V, 189L, 219V/L, 223I, 263G, 276I, 279F, 283H, 290A/Q, 298S, 304R, 334V, 341F, 344T, 366E, and 368D. In some embodiments, the recombinant methionine gamma lyases and/or biologically active recombinant methionine gamma lyase fragments comprises polypeptide sequences having at least substitutions at amino acid positions: 8, 11, 23, 55, 57, 69, 141, 165, 173, 189, 219, 223, 236, 237, 263, 267, 276, 279, 283, 290, 298, 304, 334, 341, 344, 366, and 368. In some embodiments, the recombinant methionine gamma lyases and/or biologically active recombinant methionine gamma lyase fragments comprises polypeptide sequences having at least amino acid residues: 8S, 11M, 23K, 55K/S, 57Y, 69I, 141E, 165R, 173V, 189L, 219V/L, 223I, 236R, 237K, 263G, 267E, 276I, 279F, 283H, 290A/Q, 298S, 304R, 334V, 341F, 344T, 366E, and 368D.

In some additional embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at one or more positions 2, 6/25/38/141/173/275/366/395, 6/25/55, 6/38/55/ 138, 6/38/55/138/141/288/308, 6/38/55/141/180/275/362, 6/38/55/141/180/288/362/366, 6/38/55/275/288/308, 6/38/ 138/141/173/288/366, 6/38/141/288/366, 6/55/138/173/366, 6/55/283/362/366, 6/180/362/366, 25/38/55/275/288, 25/180/288/362, 38/55/180/362/366, 38/55/362, 38/141/ 173/288/308/366, 38/141/308/362/366, 38/173, 54, 54/145, 55, 69, 69/138/140/189/199/336, 69/138/145/189/199/290/ 344, 69/138/165/189/290/296/322/336/344/398, 69/138/ 189/199/366, 69/138/189/336/344, 69/138/199/263/322/ 344/366, 69/138/336/366, 69/140/145/322/348, 69/140/165/ 189/322/366, 69/145/165/296/336/344/366, 69/145/165/ 322, 69/145/189/199/290, 69/145/189/366/398, 69/145/199/ 336/344, 69/145/322/344, 69/145/344, 69/165/189/199/263/ 336/366, 69/165/189/263/322/336, 69/165/263/290/336, 69/165/296/398, 69/165/322, 69/165/322/344/366, 69/165/ 344/366, 69/189/290/344/366, 69/189/322, 69/290/344, 69/322/344/398, 138/189/263/322/366, 140/145/189, 140/ 145/189/322/344/366, 140/165/296/322/336, 142, 145/189, 145/189/199/263/296/336/344/366, 145/189/199/322/344/ 398, 145/263/290/344/398, 145/290, 152, 165/189/199/322/ 366, 165/322/336, 165/336/344, 170, 173/366, 177, 179, 179/251, 189, 189/290/322/336/366, 189/290/322/344, 189/ 290/366, 189/322, 189/322/344, 193, 232, 267, 271, 275, 278, 287, 295, 296/344, 301, 304, 309, 322, 327, 333, 361, 366, 392, and 395, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set 2S, 2T, 6S/25E/38F/ 141E/173V/275A/366E/395D, 6S/25E/55P, 6S/38F/55P/ 138S/141E/288K/308A, 6S/38F/55P/138T, 6S/38F/55P/ 141E/180G/275A/362E, 6S/38F/55P/141E/180G/288K/ 362E/366E, 6S/38F/55P/275A/288K/308A, 6S/38F/138T/

141E/173V/288K/366E, 6S/38F/141E/288K/366E, 6S/55P/ 138T/173V/366E, 6S/55P/283H/362E/366E, 6S/180G/ 362E/366E, 6S/238F/55P/275A/288K, 25E/180G/288K/ 362E, 38F/55P/180G/362E/366E, 38F/55P/362E, 38F/ 141E/173V/288K/308A/366E, 38F/141E/308A/362E/366E, 38F/173V, 54I, 54Q, 54R/145S, 55K, 69I, 69I/138C/140T/ 189L/199T/336H, 69I/138C/145G/189L/199T/290A/344T, 69I/138C/165R/189L/290A/296N/322A/336H/344C/398P, 69I/145G/165R/296N/336H/344T/366Q, 69I/145G/165R/ 322A, 69I/145G/189L/366Q/398P, 69I/145G/199T/336H/ 344T, 69I/145G/322Q/344C, 69I/145G/344C, 69I/165R/ 189L/263P/322Q/336H, 69I/165R/263P/290A/336H, 69I/ 165R/322Q, 69I/165R/322Q/344C/366Q, 69I/165R/344C/ 366Q, 69I/290A/344T, 69I/322A/344C/398P, 69W, 69W/ 138C/189L/199T/366Q, 69W/138C/189L/336H/344C, 69W/138C/199T/263P/322A/344C/366Q, 69W/138C/ 336H/366Q, 69W/140T/145G/322Q/348V, 69W/140T/ 165R/189L/322A/366Q, 69W/145G/189L/199T/290A, 69W/165R/189L/199T/263P/336H/366Q, 69W/165R/ 296N/398P, 69W/189L/290A/344T/366Q, 69W/189L/ 322A, 138C/189L/263P/322Q/366Q, 140T/145G/189L, 140T/145G/189L/322A/344C/366Q, 140T/165R/296N/ 322Q/336H, 142L, 142S, 145G/189L, 145G/189L/199T/ 263P/296N/336H/344T/366Q, 145G/189L/199T/322A/ 344T/398P, 145G/263P/290A/344T/398P, 145G/290A, 152A, 165R/189L/199T/322Q/366Q, 165R/322A/336H, 165R/336H/344T, 170P, 170W, 173V/366E, 177T, 179A, 179S/251N, 189L, 189L/290A/322Q/336H/366Q, 189L/ 290A/322Q/344T, 189L/290A/366Q, 189L/322A, 189L/ 322A/344C, 193S, 232P, 267T, 271D, 275N, 278C, 287V, 295G, 296G/344V, 301N, 304R, 309A, 322A, 322E, 322K, 327M, 333F, 361V, 366R, 392H, or 395H, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set R2S, R2T, N6S/G25E/Y38F/Q141E/ A173V/Q275A/H366E/K395D, N6S/G25E/G55P, N6S/ Y38F/G55P/N138S/Q141E/L288K/R308A, N6S/Y38F/ G55P/N138T, N6S/Y38F/G55P/Q141E/D180G/Q275A/ Q362E, N6S/Y38F/G55P/Q141E/D180G/L288K/Q362E/ H366E, N6S/Y38F/G55P/Q275A/L288K/R308A, N6S/ Y38F/N138T/Q141E/A173V/L288K/H366E, N6S/Y38F/ Q141E/L288K/H366E, N6S/G55P/N138T/A173V/H366E, N6S/G55P/Q283H/Q362E/H366E, N6S/D180G/Q362E/ H366E, G25E/Y38F/G55P/Q275A/L288K, G25E/D180G/ L288K/Q362E, Y38F/G55P/D180G/Q362E/H366E, Y38F/ G55P/Q362E, Y38F/Q141E/A173V/L288K/R308A/ H366E, Y38F/Q141E/R308A/Q362E/H366E, Y38F/ A173V, E54I, E54Q, E54R/A145S, G55K, L69I, L69I/ N138C/L140T/Y189L/E199T/S336H, L69I/N138C/ A145G/Y189L/E199T/N290A/A344T, L69I/N138C/ Q165R/Y189L/N290A/S296N/I322A/S336H/A344C/ A398P, L69I/A145G/Q165R/S296N/S336H/A344T/ H366Q, L69I/A145G/Q165R/I322A, L69I/A145G/Y189L/ H366Q/A398P, L69I/A145G/E199T/S336H/A344T, L69I/ A145G/I322Q/A344C, L69I/A145G/A344C, L69I/Q165R/ Y189L/A263P/I322Q/S336H, L69I/Q165R/A263P/N290A/ S336H, L69I/Q165R/I322Q, L69I/Q165R/I322Q/A344C/ H366Q, L69I/Q165R/A344C/H366Q, L69I/N290A/A344T, L69I/I322A/A344C/A398P, L69W, L69W/N138C/Y189L/ E199T/H366Q, L69W/N138C/Y189L/S336H/A344C, L69W/N138C/E199T/A263P/I322A/A344C/H366Q, L69W/N138C/S336H/H366Q, L69W/L140T/A145G/ I322Q/A348V, L69W/L140T/Q165R/Y189L/I322A/ H366Q, L69W/A145G/Y189L/E199T/N290A, L69W/ Q165R/Y189L/E199T/A263P/S336H/H366Q, L69W/ Q165R/S296N/A398P, L69W/Y189L/N290A/A344T/ H366Q, L69W/Y189L/I322A, N138C/Y189L/A263P/ I322Q/H366Q, L140T/A145G/Y189L, L140T/A145G/ Y189L/I322A/A344C/H366Q, L140T/Q165R/S296N/ I322Q/S336H, A142L, A142S, A145G/Y189L, A145G/ Y189L/E199T/A263P/S296N/S336H/A344T/H366Q, A145G/Y189L/E199T/I322A/A344T/A398P, A145G/ A263P/N290A/A344T/A398P, A145G/N290A, R152A, Q165R/Y189L/E199T/I322Q/H366Q, Q165R/I322A/ S336H, Q165R/S336H/A344T, A170P, A170W, A173V/ H366E, R177T, H179A, H179S/D251N, Y189L, Y189L/ N290A/I322Q/S336H/H366Q, Y189L/N290A/I322Q/ A344T, Y189L/N290A/H366Q, Y189L/I322A, Y189L/ I322A/A344C, Y193S, D232P, D267T, A271D, Q275N, E278C, E287V, P295G, S296G/A344V, A301N, Q304R, L309A, I322A, I322E, I322K, R327M, Q333F, P361V, H366R, Q392H, or K395H, wherein the amino acid positions of the polypeptide sequence are relative to the reference sequence of SEQ ID NO: 2.

In some embodiments, the recombinant methionine gamma lyase comprises a polypeptide sequence having at least 80%, 85%, 86%, 87%, 8% 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 38/69I/344, 55/69/290/344, 55/69/322/344, 69/150/189/344, 38/69/290/ 344, 69/189/290/344, 69/290/344/388, 38/55/69/290/344, 38/69/189/290/344, 55/69/275/290/344, 38/69/189/322/344, 38/69/275/290/344, 38/69/278/290/344, 38/69/290/304/344, 38/69/290/322/344, 38/69/290/344/361, 38/69/290/344/366, 38/69/322/344/361, 69/189/290/322/344, 69/278/290/344/ 366, 38/55/69/189/290/344, 38/55/69/290/304/344, 55/69/ 275/290/344/366, 55/69/290/304/344/366, 38/55/69/189/ 275/290/344, 38/55/69/189/290/322/344, 38/55/69/189/ 275/344/361, 38/55/69/189/290/344/361, 38/55/69/189/ 344/361/366, 38/55/69/290/322/344/366, 38/69/189/290/ 304/322/344, 38/69/189/290/304/344/366, 38/55/69/189/ 290/304/322/344, 38/55/69/189/290/322/344/366, 38/55/ 69/189/290/322/344/366, 38/55/69/275/278/344/361/366, 38/55/69/304/322/344/361/366, 38/69/149/189/275/290/ 322/344, 55/69/189/290/322/344/361/366, 38/69/189/275/ 290/322/344/366, 38/55/69/150/189/322/344/361/366, 38/55/69/189/278/290/344/361/366, or 38/69/150/189/290/ 322/344/361/366, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 38F/69I/344T, 55H/69I/290A/344T, 55K/69I/ 290A/344T, 55K/69I/322A/344T, 69I/150T/189L/344T, 38F/69I/290A/344T, 38F/69I/290A/344T/366E, 69I/189L/ 290A/344T, 69I/278C/290A/344T/366E, 69I/290A/344T/ 388R, 38F/55K/69I/290A/344T, 38F/69I/189L/290A/344T, 55K/69I/275N/290A/344T, 55K/69I/275N/290A/344T/ 366E, 55H/69I/275N/290A/344T, 38F/69I/189L/322K/ 344T, 55K/69I/290A/304R/344T/366E, 38F/69I/275N/ 290A/344T, 38F/69I/278C/290A/344T, 38F/69I/290A/ 304R/344T, 38F/69I/290A/322A/344T, 38F/69I/290A/

344T/361V, 38F/69I/322A/344T/361V, 69I/189L/290A/322K/344T, 38F/55H/69I/189L/344T/361V/366E, 38F/55K/69I/290A/322K/344T/366E, 38F/69I/189L/290A/304R/344T/366E, 38F/55K/69I/189L/275N/290A/344T, 38F/55P/69I/189L/290A/322A/344T/366E, 38F/55K/69I/189L/290A/322A/344T/366E, 38F/55H/69I/189L/290A/344T/361V, 38F/55P/69I/275N/278C/344T/361V/366E, 38F/55H/69I/304R/322K/344T/361V/366E, 55K/69I/189L/290A/322K/344T/361V/366E, 38F/69I/189L/275N/290A/322K/344T/366E, 38F/69I/189L/290A/304R/322A/344T, 38F/55P/69I/150T/189L/322A/344T/361V/366E, 38F/55P/69I/189L/290A/304R/322K/344T, 38F/69I/149T/189L/275N/290A/322K/344T, 38F/69I/150T/189L/290A/322K/344T/361V/366E, 38F/55E/69I/189L/278C/290A/344T/361V/366E, 38F/55E/69I/189L/290A/322A/344T, 38F/55E/69I/189L/275N/344T/361V, 38F/55E/69I/290A/304R/344T, 38F/55E/69I/290A/344T, or 38F/55E/69I/189L/290A/344T, wherein the amino acid positions of the polypeptide sequence are relative to the reference sequence of SEQ ID NO: 2. In some embodiments, the amino acid positions are relative to the reference sequence of SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 55/69/304/344/366, 55/69/290/304/344/366, 55/58/69/290/304/344/366, 50/55/69/290/304/344/366, 55/68/69/290/304/344/366, 38/55/69/290/304/344/366, 55/69/87/290/304/344/366, 34/55/69/290/304/344/366, 29/55/69/290/304/344/366, 55/69/112/290/304/344/366, 55/69/126/290/304/344/366, 55/69/189/290/304/344/366, 55/69/220/290/304/344/366, 55/69/236/290/304/344/366, 55/69/240/290/304/344/366, 11/55/69/290/304/344/366, 55/69/279/290/304/344/366, 55/69/290/304/317/344/366, 55/69/290/304/334/344/366, 55/69/290/304/344/344/366, 55/69/290/304/344/357/366, 55/69/290/304/344/358/366, 55/69/290/304/344/364/366, 55/69/290/304/344/366/367, 43/55/69/102/290/304/344/366, 38/55/69/173/189/304/344/366, 38/55/69/173/290/304/344/366, 55/68/69/283/290/304/344/366, 38/55/69/283/290/304/344/366, 29/55/69/220/290/304/344/366, 55/68/69/290/304/344/344/366, 38/55/69/290/304/322/344/366, 55/69/165/189/290/304/344/366, 29/34/55/69/279/290/304/344/366, 38/54/55/69/290/304/336/344/366, 54/55/69/165/173/304/322/344/366, 54/55/69/165/189/304/336/344/366, 54/55/69/173/283/290/304/344/366, 38/55/69/173/189/304/322/344/366, 54/55/69/189/290/304/322/344/366, 38/55/69/165/283/290/304/344/366, 38/55/69/173/290/304/322/344/366, 55/69/165/189/283/304/336/344/366, 34/43/47/55/69/283/290/304/344/366, 38/54/55/69/189/283/290/304/344/366, 38/54/55/69/283/290/304/336/344/366, 38/55/69/165/173/189/290/304/344/366, 47/55/69/126/237/279/290/304/344/366, 34/55/69/132/279/290/304/344/344/366, 38/55/69/173/283/290/304/336/344/366, 55/69/165/173/189/283/290/304/344/366, 55/69/173/189/283/290/304/336/344/366, 34/55/68/69/132/253/283/290/304/344/366, 29/47/55/69/279/283/290/304/344/344/366, 38/54/55/69/165/173/283/290/304/336/344/366, 38/54/55/69/173/283/290/304/322/336/344/366, 29/47/55/68/69/102/132/220/250/290/304/344/344/366, or 29/34/55/68/69/220/253/279/283/290/304/344/344/366, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 55K/69I/304R/344T/366E, 55K/69I/290Q/304R/344T/366E, 55K/69I/290V/304R/344T/366E, 55K/58T/69I/290A/304R/344T/366E, 50L/55K/69I/290A/304R/344T/366E, 50V/55K/69I/290A/304R/344T/366E, 50M/55K/69I/290A/304R/344T/366E, 55K/68G/69I/290A/304R/344T/366E, 38F/55K/69I/290A/304R/344T/366E, 55K/69I/87G/290A/304R/344T/366E, 34L/55K/69I/290A/304R/344T/366E, 29T/55K/69I/290A/304R/344T/366E, 55K/69I/112A/290A/304R/344T/366E, 55K/69I/126S/290A/304R/344T/366E, 55K/69I/126R/290A/304R/344T/366E, 55K/69I/189L/290A/304R/344T/366E, 55K/69I/220V/290A/304R/344T/366E, 55K/69I/236C/290A/304R/344T/366E, 55K/69I/236A/290A/304R/344T/366E, 55K/69I/240R/290A/304R/344T/366E, 55K/69I/240P/290A/304R/344T/366E, 55K/69I/240D/290A/304R/344T/366E, 55K/69I/240G/290A/304R/344T/366E, 11M/55K/69I/290A/304R/344T/366E, 11C/55K/69I/290A/304R/344T/366E, 11A/55K/69I/290A/304R/344T/366E, 11G/55K/69I/290A/304R/344T/366E, 11H/55K/69I/290A/304R/344T/366E, 11R/55K/69I/290A/304R/344T/366E, 55K/69I/279F/290A/304R/344T/366E, 55K/69I/290A/304R/317R/344T/366E, 55K/69I/290A/304R/334V/344T/366E, 55K/69I/290A/304R/344T/344T/366E, 55K/69I/290A/304R/344T/357G/366E, 55K/69I/290A/304R/344T/357A/366E, 55K/69I/290A/304R/344T/358L/366E, 55K/69I/290A/304R/344T/364L/366E, 38F/54Q/55K/69I/290A/304R/336H/344T/366E, 38F/55K/69I/173V/290A/304R/344T/366E, 55K/68D/69I/283H/290A/304R/344T/366E, 38F/55K/69I/283H/290A/304R/344T/366E, 38F/55K/69I/290A/304R/322A/344T/366E, 55K/69I/165R/189L/290A/304R/344T/366E, 29T/34L/55K/69I/279W/290A/304R/344T/366E, 38F/54Q/55K/69I/283H/290A/304R/336H/344T/366E, 54Q/55K/69I/165R/173V/304R/322A/344T/366E, 54Q/55K/69I/165R/189L/304R/336H/344T/366E, 54Q/55K/69I/173V/283H/290A/304R/344T/366E, 38F/55K/69I/173V/189L/304R/322A/344T/366E, 54Q/55K/69I/189L/290A/304R/322A/344T/366E, 38F/55K/69I/165R/283H/290A/304R/344T/366E, 38F/55K/69I/173V/290A/304R/322A/344T/366E, 55K/69I/173V/189L/283H/290A/304R/336H/344T/366E, 55K/69I/165R/189L/283H/304R/336H/344T/366E, 34L/43A/47G/55K/69I/283H/290A/304R/344T/366E, 38F/54Q/55K/69I/189L/283H/290A/304R/344T/366E, 38F/55K/69I/165R/173V/189L/290A/304R/344T/366E, 47G/55K/69I/126A/237V/279W/290A/304R/344T/366E, 34L/55K/69I/132V/279W/290A/304R/344T/344T/366E, 38F/55K/69I/173V/283H/290A/304R/336H/344T/366E, 55K/69I/165R/173V/189L/283H/290A/304R/344T/366E, 34L/55K/68D/69I/132V/253M/283H/290A/304R/344T/366E, 29T/47G/55K/69I/279W/283H/290A/304R/344T/344T/366E 38F/54Q/55K/69I/165R/173V/283H/290A/304R/336H/344T/366E, 38F/54Q/55K/69I/173V/283H/290A/304R/322A/336H/344T/366E, 29T/47G/55K/68D/69I/102A/132V/220V/250F/290A/304R/344T/344T/366E, 29T/34L/55K/68D/69I/220V/253M/279W/283H/290A/304R/344T/344T/366E, 55K/68D/69I/290A/304R/344T/344T/366E, 29T/55K/69I/220V/290A/304R/344T/366E, 43A/55K/69I/102A/290A/304R/344T/366E, 38F/55K/69I/173V/189L/304R/344T/366E, or 55K/69I/290A/304R/344T/366E/367A, or 55K/69I/126E/290A/304R/344T/366E, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/38/55/69/165/ 173/283/290/304/344/366, 55/68/69/165/173/189/283/290/ 304/344/366, 11/54/55/69/165/173/283/290/304/344/366, 55/69/165/173/189/240/283/290/304/344/366, 11/55/69/ 165/173/189/283/290/304/344/366, 55/69/165/173/189/ 283/290/304/322/344/366, 55/69/165/173/189/283/290/ 304/336/344/366, 11/55/69/165/173/283/290/304/322/344/ 366, 11/38/54/55/69/165/173/283/290/304/344/366, 11/38/ 55/69/165/173/189/283/290/304/344/366, 11/38/55/69/165/ 173/240/283/290/304/344/366, 50/55/69/165/173/189/240/ 283/290/304/344/366, 11/54/55/69/165/173/189/283/290/ 304/344/366, 11/38/55/69/165/173/283/290/304/322/344/ 366, 38/55/69/126/165/173/283/290/304/344/366/367, 11/38/55/69/165/173/283/290/304/344/366/367, 11/55/69/ 165/173/189/240/283/290/304/344/366, 11/55/69/165/173/ 189/283/290/304/322/344/366, 11/55/69/165/173/189/283/ 290/304/336/344/366, 11/55/69/165/173/189/283/290/304/ 336/344/366, 11/55/69/165/173/189/283/290/304/344/366/ 394, 50/54/55/68/69/165/173/189/283/290/304/344/366, 38/50/54/55/69/165/173/283/290/304/344/366/367, 11/38/ 54/55/69/165/173/189/283/290/304/344/366, 11/38/54/55/ 69/165/173/240/283/290/304/344/366, 11/50/55/68/69/165/ 173/189/283/290/304/344/366, 38/54/55/69/165/173/189/ 236/283/290/304/344/366, 11/50/55/68/69/165/173/240/ 283/290/304/344/366, 11/50/55/69/126/165/173/189/283/ 290/304/344/366, 38/55/69/126/165/173/189/240/283/290/ 304/344/366, 11/38/55/69/165/173/189/283/290/304/322/ 344/366, 11/38/55/69/165/173/189/283/290/304/336/344/ 366, 11/50/55/69/165/173/189/283/290/304/344/366/367, 11/55/69/165/173/189/240/250/283/290/304/344/366, 11/38/50/55/68/69/165/173/189/283/290/304/344/366, 11/50/55/68/69/126/165/173/189/283/290/304/344/366, 11/38/50/55/69/165/173/189/240/283/290/304/344/366, 11/38/50/55/69/165/173/189/240/283/290/304/344/366, 11/38/50/55/69/165/173/189/283/290/304/344/366/367, 50/54/55/69/165/173/189/240/283/290/304/322/344/366, 11/38/55/68/69/165/173/240/283/290/304/344/366/367, 11/38/55/69/126/165/173/283/290/304/322/344/366/367, 11/50/55/69/165/173/189/240/250/283/290/304/344/366, 11/38/55/69/165/173/189/250/283/290/304/336/344/366, 11/38/50/54/55/69/126/165/173/283/290/304/322/344/366, 11/38/50/54/55/69/165/173/189/250/283/290/304/344/366, 11/38/50/55/69/126/165/173/240/250/283/290/304/344/ 366, 50/54/55/69/126/165/173/189/240/250/283/290/304/ 344/366, 11/38/54/55/69/165/173/189/250/283/290/304/ 336/344/366, 11/38/55/69/126/165/173/189/283/290/304/ 322/336/344/366, 11/38/55/69/165/173/189/283/290/304/ 322/336/344/366/367, 11/38/50/54/55/69/126/165/173/189/ 240/283/290/304/344/366, 11/38/50/54/55/69/126/165/173/ 189/240/283/290/304/344/366/367, 11/38/54/55/68/69/126/ 165/173/189/283/290/304/336/344/366/367, or 11/38/50/ 54/55/69/126/165/173/283/290/304/336/344/366/390/391, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 11A/38F/55K/69I/165R/173V/283H/290A/304R/344T/ 366E, 55K/68D/69I/165R/173V/189L/283H/290A/304R/ 344T/366E, 11A/54Q/55K/69I/165R/173V/283H/290A/ 304R/344T/366E, 55K/69I/165R/173V/189L/240R/283H/ 290A/304R/344T/366E, 11M/55K/69I/165R/173V/189L/ 283H/290V/304R/344T/366E, 11M/55K/69I/165R/173V/ 189L/283H/290A/304R/344T/366E, 55K/69I/165R/173V/ 189L/283H/290A/304R/322A/344T/366E, 55K/69I/165R/ 173V/189L/283H/290A/304R/336H/344T/366E, 11A/55K/ 69I/165R/173V/283H/290Q/304R/322A/344T/366E, 11M/ 38F/54Q/55K/69I/165R/173V/283H/290V/304R/344T/ 366E, 11M/38F/55K/69I/165R/173V/189L/283H/290A/ 304R/344T/366E, 11C/38F/55K/69I/165R/173V/189L/ 283H/290Q/304R/344T/366E, 11M/38F/55K/69I/165R/ 173V/240R/283H/290A/304R/344T/366E, 50V/55K/69I/ 165R/173V/189L/240R/283H/290A/304R/344T/366E, 11A/54Q/55K/69I/165R/173V/189L/283H/290A/304R/ 344T/366E, 11M/38F/55K/69I/165R/173V/283H/290A/ 304R/322A/344T/366E, 11A/55K/69I/165R/173V/189L/ 240R/283H/290Q/304R/344T/366E, 11M/55K/69I/165R/ 173V/189L/283H/290A/304R/322A/344T/366E, 11M/55K/ 69I/165R/173V/189L/283H/290A/304R/336H/344T/366E, 11M/55K/69I/165R/173V/189L/283H/290V/304R/336H/ 344T/366E, 50M/54Q/55K/68D/69I/165R/173V/189L/ 283H/290A/304R/344T/366E, 11M/38F/54Q/55K/69I/ 165R/173V/189L/283H/290A/304R/344T/366E, 11A/38F/ 54Q/55K/69I/165R/173V/240R/283H/290V/304R/344T/ 366E, 11M/50M/55K/68D/69I/165R/173V/189L/283H/ 290Q/304R/344T/366E, 38F/54Q/55K/69I/165R/173V/ 189L/236A/283H/290A/304R/344T/366E, 11A/50M/55K/ 68D/69I/165R/173V/240R/283H/290A/304R/344T/366E, 11A/50M/55K/69I/126A/165R/173V/189L/283H/290A/ 304R/344T/366E, 38F/55K/69I/126A/165R/173V/189L/ 240R/283H/290A/304R/344T/366E, 38F/55K/69I/126A/ 165R/173V/189L/240R/283H/290V/304R/344T/366E, 11M/38F/55K/69I/165R/173V/189L/283H/290Q/304R/ 322A/344T/366E, 11M/38F/55K/69I/165R/173V/189L/ 283H/290A/304R/336H/344T/366E, 11M/55K/69I/165R/ 173V/189L/240R/250S/283H/290Q/304R/344T/366E, 11M/38F/50M/55K/68D/69I/165R/173V/189L/283H/ 290A/304R/344T/366E, 11M/50M/55K/68D/69I/126A/ 165R/173V/189L/283H/290Q/304R/344T/366E, 11A/38F/ 50M/55K/69I/165R/173V/189L/240R/283H/290A/304R/ 344T/366E, 11M/38F/50M/55K/69I/165R/173V/189L/ 240R/283H/290A/304R/344T/366E, 50M/54Q/55K/69I/ 165R/173V/189L/240R/283H/290A/304R/322A/344T/ 366E, 11M/50V/55K/69I/165R/173V/189L/240R/250S/ 283H/290Q/304R/344T/366E, 11M/38F/55K/69I/165R/ 173V/189L/250F/283H/290A/304R/336H/344T/366E, 11M/38F/55K/69I/165R/173V/189L/283H/290Q/304R/ 322A/336H/344T/366E/367A, 11C/38F/50M/54Q/55K/69I/ 126A/165R/173V/189L/240R/283H/290V/304R/344T/ 366E, 11C/38F/50V/54Q/55K/69I/126A/165R/173V/189L/ 240R/283H/290A/304R/344T/366E/367A, 11A/38F/54Q/ 55K/68D/69I/126A/165R/173V/189L/283H/290V/304R/ 336H/344T/366E/367A, 11A/38F/50M/54Q/55K/69I/ 126A/165R/173V/283H/290A/304R/322A/344T/366E, 11M/38F/50M/54Q/55K/69I/126A/165R/173V/283H/ 290A/304R/336H/344T/366E/390L/391E, 11M/38F/50M/ 54Q/55K/69I/165R/173V/189L/250S/283H/290Q/304R/ 344T/366E, 50M/54Q/55K/69I/126A/165R/173V/189L/ 240R/250F/283H/290Q/304R/344T/366E, 11A/38F/55K/ 69I/126A/165R/173V/189L/283H/290A/304R/322A/336H/ 344T/366E, 11M/38F/50M/55K/69I/126A/165R/173V/ 240R/250F/283H/290Q/304R/344T/366E, 11A/38F/54Q/

55K/69I/165R/173V/189L/250F/283H/290A/304R/336H/ 344T/366E, 11A/38F/55K/69I/165R/173V/283H/290V/ 304R/344T/366E/367A, 38F/55K/69I/126A/165R/173V/ 283H/290A/304R/344T/366E/367A, 11M/38F/55K/69I/ 126A/165R/173V/283H/290A/304R/322A/344T/366E/ 367A, 11A/50M/55K/69I/165R/173V/189L/283H/290A/ 304R/344T/366E/367A, 11A/38F/50M/55K/69I/165R/ 173V/189L/283H/290Q/304R/344T/366E/367A, 38F/50V/ 54Q/55K/69I/165R/173V/283H/290A/304R/344T/366E/ 367A, 11M/54Q/55K/69I/126A/165R/173V/189L/283H/ 290A/304R/344T/366E/, 11M/55K/69I/165R/173V/189L/ 283H/290A/304R/344T/366E/394P, or 11M/38F/55K/68D/ 69I/165R/173V/240R/283H/290Q/304R/344T/366E/367A wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/55/69/165/ 173/189/283/290/304/344/366, 11/55/69/165/173/189/283/ 290/304/366/368, 11/55/69/165/189/283/290/304/344/366/ 368, 11/55/69/165/173/189/283/290/304/344/366/368, 11/55/69/119/165/173/189/283/290/304/344/366/368, 9/11/ 55/69/165/173/189/283/290/304/344/366/368, 8/11/55/69/ 165/173/189/283/290/304/344/366/368, 7/11/55/69/165/ 173/189/283/290/304/344/366/368, 11/21/55/69/165/173/ 189/283/290/304/344/366/368, 5/11/55/69/165/173/189/ 283/290/304/344/366/368, 11/27/55/69/165/173/189/283/ 290/304/344/366/368, 11/30/55/69/165/173/189/283/290/ 304/344/366/368, 4/11/55/69/165/173/189/283/290/304/ 344/366/368, 11/31/55/69/165/173/189/283/290/304/344/ 366/368, 11/32/55/69/165/173/189/283/290/304/344/366/ 368, 11/33/55/69/165/173/189/283/290/304/344/366/368, 11/35/55/69/165/173/189/283/290/304/344/366/368, 11/36/ 55/69/165/173/189/283/290/304/344/366/368, 3/11/55/69/ 165/173/189/283/290/304/344/366/368, 11/46/55/69/165/ 173/189/283/290/304/344/366/368, 11/48/55/69/165/173/ 189/283/290/304/344/366/368, 11/49/55/69/165/173/189/ 283/290/304/344/366/368, 11/53/55/69/165/173/189/283/ 290/304/344/366/368, 11/54/55/69/165/173/189/283/290/ 304/344/366/368, 11/55/60/69/165/173/189/283/290/304/ 344/366/368, 11/55/62/69/165/173/189/283/290/304/344/ 366/368, 11/55/66/69/165/173/189/283/290/304/344/366/ 368, 11/55/67/69/165/173/189/283/290/304/344/366/368, 11/55/69/83/165/173/189/283/290/304/344/366/368, 11/55/ 69/91/165/173/189/283/290/304/344/366/368, 11/55/69/99/ 165/173/189/283/290/304/344/366/368, 11/55/69/113/165/ 173/189/283/290/304/344/366/368, 11/55/69/124/165/173/ 189/283/290/304/344/366/368, 11/55/69/128/165/173/189/ 283/290/304/344/366/368, 11/55/69/146/165/173/189/283/ 290/304/344/366/368, 11/55/69/154/165/173/189/283/290/ 304/344/366/368, 11/55/69/156/165/173/189/283/290/304/ 344/366/368, 11/55/69/158/165/173/189/283/290/304/344/ 366/368, 11/55/69/160/165/173/189/283/290/304/344/366/ 368, 11/55/69/165/167/173/189/283/290/304/344/366/368, 11/55/69/165/173/176/189/283/290/304/344/366/368, 11/55/69/165/173/181/189/283/290/304/344/366/368, 11/55/69/165/173/183/189/283/290/304/344/366/368, 11/55/69/165/173/189/190/283/290/304/344/366/368, 11/55/69/165/173/189/195/283/290/304/344/366/368, 11/55/69/165/173/189/206/283/290/304/344/366/368, 11/55/69/165/173/189/209/283/290/304/344/366/368, 11/55/69/165/173/189/240/283/290/304/322/344/366, 11/55/69/165/173/189/214/283/290/304/344/366/368, 11/55/69/165/173/189/219/283/290/304/344/366/368, 11/55/69/165/173/189/221/283/290/304/344/366/368, 11/55/69/165/173/189/225/283/290/304/344/366/368, 11/55/69/165/173/189/231/283/290/304/344/366/368, 11/55/69/165/173/189/236/283/290/304/344/366/368, 11/55/69/165/173/189/239/283/290/304/344/366/368, 11/55/69/165/173/189/240/283/290/304/344/366/368, 11/55/69/165/173/189/242/283/290/304/344/366/368, 11/55/69/165/173/189/243/283/290/304/344/366/368, 11/55/69/165/173/189/245/283/290/304/344/366/368, 11/55/69/165/173/189/247/283/290/304/344/366/368, 11/55/69/165/173/189/251/283/290/304/344/366/368, 11/55/69/165/173/189/256/283/290/304/344/366/368, 11/55/69/165/173/189/259/283/290/304/344/366/368, 11/55/69/165/173/189/263/283/290/304/344/366/368, 11/55/69/165/173/189/269/283/290/304/344/366/368, 11/55/69/165/173/189/272/283/290/304/344/366/368, 11/55/69/165/173/189/279/283/290/304/344/366/368, 11/55/69/165/173/189/283/290/304/309/344/366/368, 11/55/69/165/173/189/283/290/304/312/344/366/368, 11/55/69/165/173/189/283/290/304/314/344/366/368, 11/55/69/165/173/189/283/290/304/315/344/366/368, 11/55/69/165/173/189/283/290/304/325/344/366/368, 11/55/69/165/173/189/283/290/304/334/344/366/368, 11/55/69/165/173/189/283/290/304/335/344/366/368, 11/55/69/165/173/189/283/290/304/338/344/366/368, 11/55/69/165/173/189/283/290/304/344/366/368/388, 11/55/69/165/173/189/283/290/304/344/366/368/390, 11/55/69/165/173/189/283/290/304/344/366/368/391, 11/55/69/165/173/189/283/290/304/344/366/368/392, 11/53/54/55/69/165/173/189/283/290/304/344/366/368, 11/54/55/69/165/173/179/189/283/290/304/344/366/368, 11/53/55/69/165/173/189/240/283/290/304/334/344/366, 11/54/55/69/165/173/189/236/283/290/304/344/366/368, 11/54/55/69/165/173/189/240/283/290/304/344/366/388, 2/11/55/69/165/173/189/283/290/304/334/344/366/368, 11/55/69/111/165/173/189/195S/283/290/304/344/366/368, 11/55/69/124/165/173/189/283/290/304/344/353/366/368, 11/55/69/165/173/179/189/279/283/290/304/344/366/368, 11/55/69/165/173/189/236/279/283/290/304/344/366/368, 11/55/69/165/173/189/256/283/290/298/304/344/366/368, 11/55/69/165/173/189/240/283/290/304/334/344/366/392, 11/55/69/165/173/189/283/290/304/322/334/344/366/368, 11/55/69/165/173/189/283/290/304/333/334/344/366/368, 11/55/69/165/173/189/283/290/304/334/336/344/366/368, 11/55/69/165/173/189/283/290/304/334/344/366/368/388, 11/55/69/165/173/189/283/290/304/334/344/366/368/392, 11/53/54/55/69/165/173/189/275/283/290/304/344/366/ 368, 11/53/54/55/69/165/173/189/283/290/304/334/344/ 366/368, 2/11/55/69/165/173/189/271/283/290/304/322/ 344/366/368, 11/55/69/165/173/189/240/283/290/304/344/ 366/368/388/392, 11/55/69/165/173/189/283/290/304/322/ 334/344/366/368/392, 11/53/54/55/69/165/173/189/240/ 283/290/304/334/344/366/368, 11/54/55/69/165/173/189/ 236/279/283/290/304/334/344/366/368/392, or 11/53/54/ 55/69/165/173/189/275/279/283/290/304/334/336/344/366/ 368, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 11M/55K/69I/124S/165R/173V/189L/283H/290A/304R/344T/366E/368D, 8S/11M/55K/69I/165R/173V/189L/283H/290A/304R/344T/366E/368D, 7V/11M/55K/69I/165R/173V/189L/283H/290A/304R/344T/366E/368D, 7E/11M/55K/69I/165R/173V/189L/283H/290A/304R/344T/366E/368D, 11M/55K/69I/83S/165R/173V/189L/283H/290A/304R/344T/366E/368D, 5H/11M/55K/69I/165R/173V/189L/283H/290A/304R/344T/366E/368D, 11M/55K/66S/69I/165R/173V/189L/283H/290A/304R/344T/366E/368D, 5H/11M/55K/69I/165R/173V/189L/283H/290A/304R/344T/366E/368D, 11M/21A/55K/69I/165R/173V/189L/283H/290A/304R/344T/366E/368D, 11M/35S/55K/69I/165R/173V/189L/283H/290A/304R/344T/366E/368D, 11M/55K/69I/124V/165R/173V/189L/283H/290A/304R/344T/366E/368D, 11M/55K/67R/69I/165R/173V/189L/283H/290A/304R/344T/366E/368D, 7G/11M/55K/69I/165R/173V/189L/283H/290A/304R/344T/366E/368D, 11M/48R/55K/69I/165R/173V/189L/283H/290A/304R/344T/366E/368D, 4R/11M/55K/69I/165R/173V/189L/283H/290A/304R/344T/366E/368D, 11M/31A/55K/69I/165R/173V/189L/283H/290A/304R/344T/366E/368D, 11M/55K/69I/124A/165R/173V/189L/283H/290A/304R/344T/366E/368D, 11M/27S/55K/69I/165R/173V/189L/283H/290A/304R/344T/366E/368D, 11M/35G/55K/69I/165R/173V/189L/283H/290A/304R/344T/366E/368D, 11M/55K/67Q/69I/165R/173V/189L/283H/290A/304R/344T/366E/368D, 11M/55K/67V/69I/165R/173V/189L/283H/290A/304R/344T/366E/368D, 5P/11M/55K/69I/165R/173V/189L/283H/290A/304R/344T/366E/368D, 11M/55K/67A/69I/165R/173V/189L/283H/290A/304R/344T/366E/368D, 11M/33T/55K/69I/165R/173V/189L/283H/290A/304R/344T/366E/368D, 11M/55K/69I/99A/165R/173V/189L/283H/290A/304R/344T/366E/368D, 8P/11M/55K/69I/165R/173V/189L/283H/290A/304R/344T/366E/368D, 3A/11M/55K/69I/165R/173V/189L/283N/290A/304R/344T/366E/368D, 11M/32N/55K/69I/165R/173V/189L/283H/290A/304R/344T/366E/368D, 3S/11M/55K/69I/165R/173V/189L/283H/290A/304R/344T/366E/368D, 11M/55K/69I/119T/165R/173V/189L/283H/290A/304R/344T/366E/368D, 11M/30N/55K/69I/165R/173V/189L/283H/290A/304R/344T/366E/368D, 5G/11M/55K/69I/165R/173V/189L/283H/290A/304R/344T/366E/368D, 8Y/11M/55K/69I/165R/173V/189L/283H/290A/304R/344T/366E/368D, 11M/55K/66Q/69I/165R/173V/189L/283H/290A/304R/344T/366E/368D, 7L/11M/55K/69I/165R/173V/189L/283H/290A/304R/344T/366E/368D, 11M/33A/55K/69I/165R/173V/189L/283H/290A/304R/344T/366E/368D, 11M/55K/69I/124R/165R/173V/189L/283H/290A/304R/344T/353T/366E/368D, 7F/11M/55K/69I/165R/173V/189L/283H/290A/304R/344T/366E/368D, 8R/11M/55K/69I/165R/173V/189L/283H/290A/304R/344T/366E/368D, 11M/46Q/55K/69I/165R/173V/189L/283H/290A/304R/344T/366E/368D, 3P/11M/55K/69I/165R/173V/189L/283H/290A/304R/344T/366E/368D, 11M/55K/69I/124H/165R/173V/189L/283H/290A/304R/344T/366E/368D, 11M/48M/55K/69I/165R/173V/189L/283H/290A/304R/344T/366E/368D, 5K/11M/55K/69I/165R/173V/189L/283H/290A/304R/344T/366E/368D, 11M/55K/69R/165R/173V/189L/283H/290A/304R/344T/366E/368D, 4G/11M/55K/69I/165R/173V/189L/283H/290A/304R/344T/366E/368D, 9A/11M/55K/69I/165R/173V/189L/283H/290A/304R/344T/366E/368D, 11M/55K/69I/165R/173V/189L/231V/283H/290A/304R/344T/366E/368D, 11M/55K/69I/165R/173V/189L/214C/283H/290A/304R/344T/366E/368D, 11M/55K/69I/165R/173V/181I/189L/283H/290A/304R/344T/366E/368D, 11M/55K/69I/146S/165R/173V/189L/283H/290A/304R/344T/366E/368D, 11M/55K/69I/165R/173V/189L/243C/283H/290A/304R/344T/366E/368D, 11M/55K/69I/165R/173V/189L/243G/283H/290A/304R/344T/366E/368D, 11M/55K/69I/128H/165R/173V/189L/283H/290A/304R/344T/366E/368D, 11M/55K/69I/165R/173V/176V/189L/283H/290A/304R/344T/366E/368D, 11M/55K/69I/165R/173V/189L/251A/283H/290A/304R/344T/366E/368D, 11M/55K/69I/165R/189L/283H/290A/304R/344T/366E/368D, 11M/55K/69I/165R/173V/189L/245G/283H/290A/304R/344T/366E/368D, 11M/55K/69I/111H/165R/173V/189L/195S/283H/290A/304R/344T/366E/368D, 11M/55K/69I/154V/165R/173V/189L/283H/290A/304R/344T/366E/368D, 11M/55K/69I/165R/173V/189L/245S/283H/290A/304R/344T/366E/368D, 11M/55K/69I/165R/173V/189L/195T/283H/290A/304R/344T/366E/368D, 11M/55K/69I/165R/173V/189L/243S/283H/290A/304R/344T/366E/368D, 11M/55K/69I/165R/173V/183V/189L/283H/290A/304R/344T/366E/368D, 11M/55K/69I/165R/173V/189L/247M/283H/290A/304R/344T/366E/368D, 11M/55K/69I/165R/173V/189L/225C/283H/290A/304R/344T/366E/368D, 11M/55K/69I/165R/167T/173V/189L/283H/290A/304R/344T/366E/368D, 11M/55K/69I/165R/173V/189L/283H/290A/304R/335I/344T/366E/368D, 11M/55K/69I/165R/173V/189L/259L/283H/290A/304R/344T/366E/368D, 11M/55K/69I/165R/173V/189L/263S/283H/290A/304R/344T/366E/368D, 11M/55K/69I/165R/173V/189L/263G/283H/290A/304R/344T/366E/368D, 11M/55K/69I/165R/173V/189L/242F/283H/290A/304R/344T/366E/368D, 11M/55K/69I/165R/173V/189L/283H/290A/304R/312A/344T/366E/368D, 11M/55K/69I/165R/173V/189L/283H/290A/304R/344T/366E/368D/390L, 11M/55K/69I/165R/173V/189L/283H/290A/304R/344T/366E/368D/386I, 11M/55K/69I/165R/173V/189L/272S/283H/290A/304R/344T/366E/368D, 11M/55K/69I/165R/173V/189L/283H/290A/304R/366E/368D, 11M/55K/69I/165R/173V/189L/256V/283H/290A/304R/344T/366E/368D, 11M/55K/69I/165R/173V/189L/283H/290A/304R/344R/366E/368D, 11M/55K/69I/165R/173V/189L/283H/290A/304R/315S/344T/366E/368D, 11M/55K/69I/165R/173V/189L/283H/290A/304R/314L/344T/366E/368D, 11M/49T/55K/69I/165R/173V/189L/283H/290A/304R/344T/366E/368D, 11M/55K/69I/165R/173V/189L/283H/290A/304R/344S/366E/368D, 11M/55K/69I/165R/173V/189L/283H/290A/304R/325A/344T/366E/368D, 11M/55K/69I/165R/173V/189L/263Q/283H/290A/304R/344T/366E/368D, 11M/55K/69I/165R/173V/189L/283H/290A/304R/344G/366E/368D, 11M/49A/55K/69I/165R/173V/189L/283H/290A/304R/344T/366E/368D, 11M/55K/69I/165R/173V/189L/263K/283H/290A/304R/344T/366E/368D, 11M/55K/69I/165R/173V/189L/256L/283H/290A/298V/304R/344T/366E/368D, 11M/55K/69I/165R/173V/189L/269S/283H/290A/304R/344T/366E/368D, 11M/36S/55K/69I/165R/173V/189L/283H/290A/304R/344T/366E/368D, 11M/55K/69I/165R/173V/189L/239T/283H/290A/304R/344T/366E/368D, 11M/55K/62C/69I/165R/173V/189L/283H/290A/304R/344T/366E/368D, 11M/55K/60T/69I/165R/173V/189L/283H/290A/304R/344T/366E/368D, 11M/55K/69I/165R/173V/189L/239V/283H/290A/304R/344T/366E/368D, 11M/55K/69I/165R/173V/189L/219L/283H/290A/304R/344T/366E/368D, 11M/55K/69I/165R/173V/189L/190L/283H/290A/304R/344T/366E/368D, 11M/55K/69I/91S/165R/173V/189L/283H/290A/304R/344T/366E/368D, 11M/55K/69I/165R/173V/189L/190G/283H/290A/304R/344T/366E/368D, 11M/55K/69I/165R/173V/189L/219V/283H/290A/304R/344T/366E/368D, 11M/55K/69I/113T/165R/173V/189L/283H/290A/304R/

344T/366E/368D, 11M/55K/69I/165R/173V/189L/209G/ 283H/290A/304R/344T/366E/368D, 11M/55K/62A/69I/ 165R/173V/189L/283H/290A/304R/344T/366E/368D, 11M/55K/69I/165R/173V/189L/221G/283H/290A/304R/ 344T/366E/368D, 11M/55K/69I/165R/173V/189L/206I/ 283H/290A/304R/344T/366E/368D, 11M/55K/69I/165R/ 173V/189L/239Y/283H/290A/304R/344T/366E/368D, 11M/55K/69I/113M/165R/173V/189L/283H/290A/304R/ 344T/366E/368D, 11M/55K/62H/69I/165R/173V/189L/ 283H/290A/304R/344T/366E/368D, 11M/55K/69I/158S/ 165R/173V/189L/283H/290A/304R/344T/366E/368D, 11M/55K/69I/156L/165R/173V/189L/283H/290A/304R/ 344T/366E/368D, 11M/55K/69I/165R/173V/189L/239C/ 283H/290A/304R/344T/366E/368D, 11M/55K/69I/160M/ 165R/173V/189L/283H/290A/304R/344T/366E/368D, 11M/55K/69I/165R/173V/189L/283H/290A/304R/338G/ 344T/366E/368D, 11M/55K/69I/165R/173V/189L/283H/ 290A/304R/333S/334V/344T/366E/368D, 11M/55K/69I/ 165R/173V/189L/283H/290Q/304R/344T/366E/368D, 11M/53L/54Q/55H/69I/165R/173V/189L/283H/290V/ 304R/344T/366E/368D, 11M/53L/54Q/55K/69I/165R/ 173V/189L/275N/279F/283H/290A/304R/334V/336H/ 344T/366E/368D, 11M/53L/55K/69I/165R/173V/189L/ 283H/290A/304R/344T/366E/368D, 11M/54Q/55K/69I/ 165R/173V/189L/236Y/283H/290A/304R/344T/366E/ 368D, 11M/55K/69I/165R/173V/179A/189L/279F/283H/ 290A/304R/344T/366E/368D, 11M/55K/69I/165R/173V/ 189L/236Y/283H/290A/304R/344T/366E/368D, 11M/53L/ 54Q/55K/69I/165R/173V/189L/283H/290V/304R/344T/ 366E/368D, 11M/55K/69I/165R/173V/189L/283H/290A/ 304R/344T/366E/368D, 11M/55K/69I/165R/173V/189L/ 283H/290V/304R/334V/336H/344T/366E/368D, 11M/ 55H/69I/165R/173V/189L/236Y/283H/290Q/304R/344T/ 366E/368D, 11M/53L/54Q/55K/69I/165R/173V/189L/ 283H/290A/304R/344T/366E/368D, 11M/55K/69I/165R/ 173V/189L/236Y/279F/283H/290A/304R/344T/366E/ 368D, 11M/54Q/55K/69I/165R/173V/189L/283H/290V/ 304R/344T/366E/368D, 11M/55K/69I/165R/173V/189L/ 279F/283H/290A/304R/344T/366E/368D, 11M/55K/69I/ 165R/173V/189L/283H/290A/304R/344T/366E/368D/ 392H, 11M/53L/54Q/55K/69I/165R/173V/189L/275H/ 283H/290V/304R/344T/366E/368D, 11M/54Q/55K/69I/ 165R/173V/179A/189L/283H/290A/304R/344T/366E/ 368D, 11M/55K/69I/165R/173V/189L/283H/290Q/304R/ 334V/344T/366E/368D, 11M/55K/69I/165R/173V/189L/ 283H/290A/304R/334V/344T/366E/368D, 11M/55K/69I/ 165R/173V/189L/283H/290Q/304R/322K/334V/344T/ 366E/368D/392H, 11M/55K/69I/165R/173V/189L/283H/ 290Q/304R/322K/334V/344T/366E/368D, 11M/55K/69I/ 165R/173V/189L/283H/290Q/304R/334V/344T/366E/ 368D/392H, 11M/53L/54Q/55H/69I/165R/173V/189L/ 283H/290Q/304R/334V/344T/366E/368D, 11M/54Q/55H/ 69I/165R/173V/189L/283H/290Q/304R/344T/366E/368D, 2S/11M/55E/69I/165R/173V/189L/283H/290Q/304R/ 334V/344T/366E/368D, 2S/11M/55K/69I/165R/173V/ 189L/271D/283H/290Q/304R/322K/344T/366E/368D, 11M/55K/69I/165R/173V/189L/283H/290Q/304R/344T/ 366E/368D, 11M/55K/69I/165R/173V/189L/283H/290A/ 304R/344T/366E/368D/388R, 11M/55K/69I/165R/173V/ 189L/283H/290A/304R/344T/366E/368D/391N, 11M/55K/ 69I/165R/173V/189L/283H/290A/304R/344T/366E/368D, 11M/55K/69I/165R/173V/189L/283H/290A/304R/309A/ 344T/366E/368D, 11M/55K/69I/165R/173V/189L/240R/ 283H/290A/304R/344T/366E/368D/388R/392H, 11M/55H/ 69I/165R/173V/189L/240R/283H/290A/304R/344T/366E/ 368D, 11M/54Q/55K/69I/165R/173V/189L/240R/283H/ 290A/304R/344T/366E/368D/388R, 11M/55K/69I/165R/173V/ 189L/240R/283H/290A/304R/344T/366E/367A, 11M/55K/ 69I/165R/173V/189L/240R/283H/290A/304R/322K/344T/ 366E, 11M/55K/69I/165R/173V/189L/283H/290A/304R/ 334V/344T/366E/368D/388R, 11M/55K/69I/165R/173V/ 189L/240R/283H/290A/304R/334V/344T/366E/392H, 11M/53L/54Q/55K/69I/165R/173V/189L/240R/283H/ 290A/304R/334V/344T/366E/368D, 11M/53L/55K/69I/ 165R/173V/189L/240R/283H/290A/304R/334V/344T/ 366E, 11M/54Q/55H/69I/165R/173V/189L/236Y/279F/ 283H/290Q/304R/334V/344T/366E/368D/392H, 11M/ 55K/69I/165R/173V/189L/283H/290A/304R/344T/366E, or 11M/55K/69I/165R/173V/189L/283H/290A/304R/344T/ 366E, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/55/69/165/ 173/189/283/290/304/344/366, 11/55/69/165/173/189/219/ 283/290/304/344/366, 11/55/69/165/173/189/272/283/290/ 304/344/366, 11/55/69/165/173/189/283/290/304/334/344/ 366, 11/55/69/165/173/189/283/290/304/344/366/368, 11/55/69/165/189/283/290/304/334/344/366/368, 11/55/69/ 119/165/173/189/283/290/304/315/344/366, 11/55/69/165/ 173/189/279/283/290/304/334/344/366, 11/55/69/165/173/ 189/263/283/290/304/344/366/368, 11/55/69/165/173/189/ 283/290/304/322/334/344/366, 11/55/69/165/173/189/283/ 290/304/315/344/366/368, 8/11/55/69/165/173/189/283/ 290/304/334/344/366/368, 11/55/69/83/165/173/189/283/ 290/304/334/344/366/368, 11/55/69/165/173/189/219/263/ 283/290/304/344/366/368, 11/55/69/165/173/189/190/283/ 290/304/334/344/366/368, 11/55/69/165/173/189/206/283/ 290/304/334/344/366/368, 11/55/69/165/173/189/219/283/ 290/304/334/344/366/368, 11/55/69/165/173/189/263/283/ 290/304/334/344/366/368, 11/55/69/165/173/189/272/283/ 290/304/334/344/366/368, 11/55/69/165/173/189/279/283/ 290/304/334/344/366/368, 11/55/69/165/173/189/283/290/ 304/322/334/344/366/368, 3/8/11/55/69/165/173/189/283/ 290/304/334/344/366/368, 8/11/55/69/83/165/173/189/219/ 240/283/290/304/344/366, 8/11/55/69/165/173/189/219/ 272/283/290/304/334/344/366/368, or 11/55/69/127/165/ 173/189/279/283/290/304/322/334/344/366/368, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 11M/55K/69I/165R/ 173V/189L/283H/290Q/304R/344T/366E, 11M/55K/69I/ 165R/173V/189L/219V/283H/290Q/304R/344T/366E, 11M/55K/69I/165R/173V/189L/272S/283H/290Q/304R/ 344T/366E, 11M/55K/69I/165R/173V/189L/283H/290Q/ 304R/334V/344T/366E, 11M/55K/69I/119T/165R/173V/ 189L/283H/290Q/304R/315S/344T/366E, 11M/55K/69I/ 165R/173V/189L/279F/283H/290Q/304R/334V/344T/ 366E, 8S/11M/55K/69I/83S/165R/173V/189L/219V/240R/ 283H/290Q/304R/344T/366E, 11M/55K/69I/127Q/165R/ 173V/189L/279F/283H/290Q/304R/322K/334V/344T/

366E/368D, 11M/55K/69I/165R/173V/189L/279F/283H/ 290Q/304R/334V/344T/366E/368D, 11M/55K/69I/165R/ 173V/189L/206I/283H/290Q/304R/334V/344T/366E/ 368D, 11M/55K/69I/165R/173V/189L/283H/290Q/304R/ 322K/334V/344T/366E, 11M/55K/69I/165R/173V/189L/ 283H/290Q/304R/322K/334V/344T/366E/368D, 11M/ 55K/69I/165R/173V/189L/263G/283H/290Q/304R/334V/ 344T/366E/368D, 11M/55K/69I/165R/173V/189L/283H/ 290Q/304R/344T/366E/368D, 11M/55K/69I/165R/173V/ 189L/263G/283H/290Q/304R/344T/366E/368D, 11M/55K/ 69I/165R/173V/189L/190G/283H/290Q/304R/334V/344T/ 366E/368D, 11M/55K/69I/165R/173V/189L/219V/283H/ 290Q/304R/334V/344T/366E/368D, 8S/11M/55K/69I/ 165R/173V/189L/283H/290Q/304R/334V/344T/366E/ 368D, 8S/11M/55K/69I/165R/173V/189L/219V/272S/ 283H/290Q/304R/334V/344T/366E/368D, 11M/55K/69I/ 165R/173V/189L/219V/263G/283H/290Q/304R/344T/ 366E/368D, 11M/55K/69I/83S/165R/173V/189L/283H/ 290Q/304R/334V/344T/366E/368D, 3P/8S/11M/55K/69I/ 165R/173V/189L/283H/290Q/304R/334V/344T/366E/ 368D, 11M/55K/69I/165R/173V/189L/283H/290Q/304R/ 315S/344T/366E/368D, 11M/55K/69I/165R/173V/189L/ 272S/283H/290Q/304R/334V/344T/366E/368D, or 11M/ 55K/69I/165R/189L/283H/290Q/304R/334V/344T/366E/ 368D, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/55/69/165/ 173/189/219/263/283/290/304/366/368, 11/55/69/165/173/ 189/219/283/290/304/344/366/368, 11/55/69/127/165/173/ 189/219/263/283/290/304/366/368, 11/55/69/141/165/173/ 189/219/272/283/290/304/366/368, 11/55/69/149/165/173/ 189/219/263/283/290/304/366/368, 11/55/69/165/173/189/ 219/240/263/283/290/304/366/368, 11/55/69/165/173/189/ 219/240/283/290/304/344/366/368, 11/55/69/165/173/189/ 219/263/283/290/304/344/366/368, 11/55/69/165/173/189/ 219/263/283/290/304/366/368/395, 11/54/55/57/69/165/ 173/189/219/263/283/290/304/366/368, 3/11/55/57/69/165/ 189/219/263/283/290/304/344/366/368, 6/11/55/69/165/ 173/189/219/263/283/290/304/344/366/368, 11/55/57/69/ 127/165/173/189/219/263/283/290/304/366/368, 11/23/55/ 69/165/173/189/219/263/283/290/304/344/366/368, 11/55/ 57/69/141/165/173/189/219/263/283/290/304/366/368, 5/11/55/69/165/173/189/219/263/283/290/304/344/366/ 368, 11/51/55/69/165/173/189/219/263/283/290/304/344/ 366/368, 11/51/55/69/165/173/189/219/263/283/290/304/ 344/366/368, 11/55/57/69/165/173/189/219/263/283/290/ 304/344/366/368, 11/55/69/141/149/165/173/189/219/263/ 283/290/304/366/368, 11/55/69/127/165/173/189/219/263/ 283/290/304/344/366/368, 11/55/69/141/165/173/189/219/ 263/283/290/304/344/366/368, 11/55/69/144/165/173/189/ 219/263/283/290/304/344/366/368, 11/55/69/149/165/173/ 189/219/263/283/290/304/366/368, 5/7/11/55/69/165/ 173/189/219/263/283/290/304/344/366/368, 11/55/69/165/ 173/189/190/219/263/283/290/304/344/366/368, 11/55/69/ 165/173/189/219/223/263/283/290/304/344/366/368, 11/55/69/165/173/189/219/228/263/283/290/304/344/366/ 368, 11/55/69/165/173/189/219/229/263/283/290/304/344/ 366/368, 11/55/69/165/173/189/219/239/263/283/290/304/ 344/366/368, 11/55/69/165/173/189/219/240/263/283/290/ 304/344/366/368, 11/55/69/165/173/189/219/252/263/283/ 290/304/344/366/368, 11/55/69/165/173/189/219/255/263/ 283/290/304/344/366/368, 11/55/69/165/173/189/219/256/ 263/283/290/304/344/366/368, 11/55/69/165/173/189/219/ 263/270/283/290/304/344/366/368, 11/55/69/165/173/189/ 219/263/276/283/290/304/344/366/368, 11/55/69/165/173/ 189/219/263/282/283/290/304/344/366/368, 11/55/69/165/ 173/189/219/263/283/284/290/304/344/366/368, 11/55/69/ 165/173/189/219/263/283/288/290/304/344/366/368, 11/55/69/165/173/189/219/263/283/290/298/304/344/366/ 368, 11/55/69/165/173/189/219/263/283/290/301/304/344/ 366/368, 7/11/41/55/69/149/165/173/189/219/263/283/290/ 304/366/368, 11/55/69/165/173/189/219/263/283/290/304/ 315/344/366/368, 11/55/69/165/173/189/219/263/283/290/ 304/316/344/366/368, 11/55/69/165/173/189/219/263/283/ 290/304/323/344/366/368, 11/55/69/165/173/189/219/263/ 283/290/304/324/344/366/368, 11/55/69/165/173/189/219/ 263/283/290/304/335/344/366/368, 11/55/69/165/173/189/ 219/263/283/290/304/341/344/366/368, 11/55/69/165/173/ 189/219/263/283/290/304/344/362/366/368, 11/55/69/165/ 173/189/219/263/283/290/304/344/365/366/368, 11/55/69/ 165/173/189/219/263/283/290/304/344/366/368/398, 5/7/ 11/54/55/57/69/165/173/189/219/263/283/290/304/366/ 368, 7/11/55/69/165/173/189/219/240/263/283/290/304/ 344/366/368, 7/11/55/69/165/173/189/219/263/272S/283/ 290/304/344/366/368, 5/11/55/69/165/173/189/219/240/ 263/283/290/304/344/366/368, 11/55/57/69/165/173/189/ 219/240/263/283/290/304/344/366/368, 11/54/55/69/165/ 173/189/219/263/272/283/290/304/344/366/368, 11/55/57/ 69/165/173/189/219/263/272/283/290/304/344/366/368, 11/55/57/69/165/173/189/219/263/283/290/298/304/344/ 366/368, 5/7/11/55/69/149/165/173/189/219/263/283/290/ 304/344/366/368, 11/55/69/127/165/173/189/219/263/279/ 282/283/290/304/366/368, 11/55/69/127/165/173/189/219/ 240/263/283/290/304/344/366/368, 11/55/69/141/165/173/ 189/219/263/279/283/290/304/344/366/368, 11/55/69/149/ 165/173/189/219/263/282/283/290/304/344/366/368, 11/55/69/149/165/173/189/219/263/283/290/298/304/344/ 366/368, 11/55/69/149/165/173/189/219/263/272/283/290/ 304/366/368/395, 11/55/69/165/173/189/219/263/279/282/ 283/290/304/344/366/368, 7/11/55/69/127/165/173/189/ 219/240/263/283/290/304/344/366/368, 7/11/55/69/165/ 173/178/189/219/240/263/283/290/304/344/366/368, 5/11/ 55/69/165/173/189/219/240/263/272/283/290/298/304/366/ 368, 11/54/55/69/127/165/173/189/219/263/282/283/290/ 304/344/366/368, 3/11/55/69/141/165/173/189/219/263/ 283/290/304/344/366/368/395, 11/55/69/149/165/173/189/ 219/240/263/272/283/290/304/344/366/368, 11/55/69/149/ 165/173/189/219/263/272/282/283/290/298/304/366/368, 5/11/55/69/127/149/165/173/189/219/240/263/283/290/ 304/366/368/395, 5/11/55/69/141/165/173/178/189/219/ 240/263/283/290/304/344/366/368, 7/11/54/55/69/127/165/ 173/189/219/228/240/263/283/290/298/304/366/368, 11/55/69/165/173/189/219/233/240/272/283/290/304/344/ 366/368/395, 7/11/55/57/69/141/165/173/189/219/263/279/ 283/290/298/304/344/366/368/395, 7/11/55/69/165/173/ 189/219/240/263/272/283/290/304/344/366/368/395, 5/11/ 41/55/69/165/173/189/219/263/272/279/283/290/304/344/ 366/368, 11/55/69/127/149/165/173/189/219/263/272/279/ 282/283/290/298/304/366/368, or 11/55/69/127/149/165/ 173/189/219/240/263/283/290/298/304/344/366/368, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 11M/55K/57Y/69I/127K/165R/173V/189L/219V/263G/ 283H/290Q/304R/366E/368D, 11M/23K/55K/69I/165R/ 173V/189L/219V/263G/283H/290Q/304R/344T/366E/ 368D, 11M/51S/55K/69I/165R/173V/189L/219V/263G/ 283H/290Q/304R/344T/366E/368D, 11M/51N/55K/69I/ 165R/173V/189L/219V/263G/283H/290Q/304R/344T/ 366E/368D, 11M/51K/55K/69I/165R/173V/189L/219V/ 263G/283H/290Q/304R/344T/366E/368D, 11M/55K/57Y/ 69I/165R/173V/189L/219V/263G/283H/290Q/304R/344T/ 366E/368D, 11M/54R/55K/69I/127K/165R/173V/189L/ 219V/263G/282A/283H/290Q/304R/344T/366E/368D, 11M/55K/69I/127K/149D/165R/173V/189L/219V/240R/ 263G/283H/290Q/298P/304R/344T/366E/368D, 11M/55K/ 69I/127K/149D/165R/173V/189L/219V/263G/272S/279F/ 282A/283H/290Q/298P/304R/366E/368D, 11M/55K/57Y/ 69I/165R/173V/189L/219V/240R/263G/283H/290Q/304R/ 344T/366E/368D, 11M/54R/55K/69I/165R/173V/189L/ 219V/263G/272S/283H/290Q/304R/344T/366E/368D, 11M/55K/57Y/69I/165R/173V/189L/219V/263G/272S/ 283H/290Q/304R/344T/366E/368D, 11M/55K/57Y/69I/ 165R/173V/189L/219V/263G/283H/290Q/298P/304R/ 344T/366E/368D, 11M/55K/69I/149D/165R/173V/189L/ 219V/240R/263G/272S/283H/290Q/304R/344T/366E/ 368D, 11M/55K/69I/127K/165R/173V/189L/219V/263G/ 279F/282A/283H/290Q/304R/366E/368D, 11M/55K/69I/ 127K/165R/173V/189L/219V/240R/263G/283H/290Q/ 304R/344T/366E/368D, 11M/55K/69I/149D/165R/173V/ 189L/219V/263G/272S/282A/283H/290Q/298P/304R/ 366E/368D, 11M/55K/69I/149D/165R/173V/189L/219V/ 263G/282A/283H/290Q/304R/344T/366E/368D, 11M/ 55K/69I/149D/165R/173V/189L/219V/263G/272S/283H/ 290Q/304R/366E/368D/395D, 11M/55K/69I/149D/165R/ 173V/189L/219V/263G/283H/290Q/298P/304R/344T/ 366E/368D, 11M/55K/69I/127A/165R/173V/189L/219V/ 263G/283H/290Q/304R/344T/366E/368D, 11M/55K/69I/ 127V/165R/173V/189L/219V/263G/283H/290Q/304R/ 344T/366E/368D, 11M/55K/69I/127K/165R/173V/189L/ 219V/263G/283H/290Q/304R/344T/366E/368D, 11M/ 55K/69I/141G/165R/173V/189L/219V/263G/283H/290Q/ 304R/344T/366E/368D, 11M/55K/69I/141P/165R/173V/ 189L/219V/263G/283H/290Q/304R/344T/366E/368D, 11M/55K/69I/141T/165R/173V/189L/219V/263G/283H/ 290Q/304R/344T/366E/368D, 11M/55K/69I/141S/165R/ 173V/189L/219V/263G/283H/290Q/304R/344T/366E/ 368D, 11M/55K/69I/141R/165R/173V/189L/219V/263G/ 283H/290Q/304R/344T/366E/368D, 11M/55K/69I/144R/ 165R/173V/189L/219V/263G/283H/290Q/304R/344T/ 366E/368D, 11M/55K/69I/149T/165R/173V/189L/219V/ 263G/283H/290Q/304R/344T/366E/368D, 11M/55K/69I/ 149D/165R/173V/189L/219V/263G/283H/290Q/304R/ 344T/366E/368D, 11M/55K/69I/165R/173V/189L/219V/ 233Q/240R/272S/283H/290Q/304R/344T/366E/368D/ 395D, 11M/55K/69I/165R/173V/189L/190A/219V/263G/ 283H/290Q/304R/344T/366E/368D, 11M/55K/69I/165R/ 173V/189L/219V/263G/279F/282A/283H/290Q/304R/ 344T/366E/368D, 11M/55K/69I/165R/173V/189L/219V/ 223I/263G/283H/290Q/304R/344T/366E/368D, 11M/55K/ 69I/165R/173V/189L/219V/228R/263G/283H/290Q/304R/ 344T/366E/368D, 11M/55K/69I/165R/173V/189L/219V/ 229S/263G/283H/290Q/304R/344T/366E/368D, 11M/55K/ 69I/165R/173V/189L/219V/229H/263G/283H/290Q/304R/ 344T/366E/368D, 11M/55K/69I/165R/173V/189L/219V/ 239K/263G/283H/290Q/304R/344T/366E/368D, 11M/ 55K/69I/165R/173V/189L/219V/240R/263G/283H/290Q/ 304R/344T/366E/368D, 11M/55K/69I/165R/173V/189L/ 219V/252C/263G/283H/290Q/304R/344T/366E/368D, 11M/55K/69I/165R/173V/189L/219V/255V/263G/283H/ 290Q/304R/344T/366E/368D, 11M/55K/69I/165R/173V/ 189L/219V/256L/263G/283H/290Q/304R/344T/366E/ 368D, 11M/55K/69I/165R/173V/189L/219V/263G/270S/ 283H/290Q/304R/344T/366E/368D, 11M/55K/69I/165R/ 173V/189L/219V/263G/276I/283H/290Q/304R/344T/ 366E/368D, 11M/55K/69I/165R/173V/189L/219V/263G/ 276L/283H/290Q/304R/344T/366E/368D, 11M/55K/69I/ 165R/173V/189L/219V/263G/282V/283H/290Q/304R/ 344T/366E/368D, 11M/55K/69I/165R/173V/189L/219V/ 263G/282N/283H/290Q/304R/344T/366E/368D, 11M/ 55K/69I/165R/173V/189L/219V/263G/282A/283H/290Q/ 304R/344T/366E/368D, 11M/55K/69I/165R/173V/189L/ 219V/263G/282A/283H/290Q/304R/344T/366E/368D, 11M/55K/69I/165R/173V/189L/219V/263G/283H/284S/ 290Q/304R/344T/366E/368D, 11M/55K/69I/165R/173V/ 189L/219V/263G/283H/284A/290Q/304R/344T/366E/ 368D, 11M/55K/69I/165R/173V/189L/219V/263G/283H/ 288T/290Q/304R/344T/366E/368D, 11M/55K/69I/165R/ 173V/189L/219V/263G/283H/288A/290Q/304R/344T/ 366E/368D, 11M/55K/69I/165R/173V/189L/219V/263G/ 283H/288W/290Q/304R/344T/366E/368D, 11M/55K/69I/ 165R/173V/189L/219V/263G/283H/288G/290Q/304R/ 344T/366E/368D, 11M/55K/69I/165R/173V/189L/219V/ 263G/283H/288I/290Q/304R/344T/366E/368D, 11M/55K/ 69I/165R/173V/189L/219V/263G/283H/288R/290Q/304R/ 344T/366E/368D, 11M/55K/69I/165R/173V/189L/219V/ 263G/283H/288S/290Q/304R/344T/366E/368D, 11M/55K/ 69I/165R/173V/189L/219V/263G/283H/288M/290Q/ 304R/344T/366E/368D, 11M/55K/69I/165R/173V/189L/ 219V/263G/283H/288Q/290Q/304R/344T/366E/368D, 11M/55K/69I/165R/173V/189L/219V/263G/283H/290Q/ 298K/304R/344T/366E/368D, 11M/55K/69I/165R/173V/ 189L/219V/263G/283H/290Q/298S/304R/344T/366E/ 368D, 11M/55K/69I/165R/173V/189L/219V/263G/283H/ 290Q/298G/304R/344T/366E/368D, 11M/55K/69I/165R/ 173V/189L/219V/263G/283H/290Q/298P/304R/344T/ 366E/368D, 11M/55K/69I/165R/173V/189L/219V/263G/ 283H/290Q/298P/304R/344T/366E/368D, 11M/55K/69I/ 165R/173V/189L/219V/263G/283H/290Q/301K/304R/ 344T/366E/368D, 11M/55K/69I/165R/173V/189L/219V/ 263G/283H/290Q/301D/304R/344T/366E/368D, 11M/ 55K/69I/165R/173V/189L/219V/263G/283H/290Q/301Q/ 304R/344T/366E/368D, 11M/55K/69I/165R/173V/189L/ 219V/263G/283H/290Q/304R/315S/344T/366E/368D, 11M/55K/69I/165R/173V/189L/219V/263G/283H/290Q/ 304R/316L/344T/366E/368D, 11M/55K/69I/165R/173V/ 189L/219V/263G/283H/290Q/304R/323T/344T/366E/ 368D, 11M/55K/69I/165R/173V/189L/219V/263G/283H/ 290Q/304R/323K/344T/366E/368D, 11M/55K/69I/165R/ 173V/189L/219V/263G/283H/290Q/304R/324S/344T/ 366E/368D, 11M/55K/69I/165R/173V/189L/219V/263G/ 283H/290Q/304R/335I/344T/366E/368D, 11M/55K/69I/ 165R/173V/189L/219V/263G/283H/290Q/304R/341F/ 344T/366E/368D, 11M/55K/69I/165R/173V/189L/219V/ 263G/283H/290Q/304R/344T/362R/366E/368D, 11M/55K/ 69I/165R/173V/189L/219V/263G/283H/290Q/304R/344T/ 365K/366E/368D, 11M/55K/69I/165R/173V/189L/219L/ 263G/283H/290Q/304R/344T/366E/368D, 11M/55K/69I/ 165R/173V/189I/219V/263G/283H/290Q/304R/344T/ 366E/368D, 6R/11M/55K/69I/165R/173V/189L/219V/ 263G/283H/290Q/304R/344T/366E/368D, 11M/55K/69I/ 165R/173V/189L/219V/263G/283H/290Q/304R/344T/ 366E/368D/384S, 6L/11M/55K/69I/165R/173V/189L/

219V/263G/283H/290Q/304R/344T/366E/368D, 6S/11M/ 55K/69I/165R/173V/189L/219V/263G/283H/290Q/304R/ 344T/366E/368D, 11M/55K/69I/165R/173V/189L/219V/ 263G/283H/290Q/301E/304R/344T/366E/368D, 11M/55K/ 69I/165R/173V/189L/219V/263G/283H/290Q/304R/344T/ 366E/368D/396V, 11M/55K/69I/165R/173V/189L/219V/ 263G/283H/290Q/304R/344T/366E/368D/395R, 11M/55K/ 69I/165R/173V/189L/219V/263G/283H/290Q/304R/344T/ 366E/368D/396R, 11M/55K/69I/165R/173V/189L/219V/ 263G/283H/290Q/304R/344T/366E/368D/398G, 11M/ 55K/69I/165R/173V/189L/219V/263G/283H/290Q/304R/ 344T/366E/368D/398Q, 5H/11M/55K/69I/141E/165R/ 173V/178A/189L/219V/240R/263G/283H/290Q/304R/ 344T/366E/368D, 11M/55K/69I/127K/165R/173V/189L/ 219V/263G/283H/290Q/304R/366E/368D, 7E/11M/55K/ 57Y/69I/141E/165R/173V/189L/219V/263G/279F/283H/ 290Q/298P/304R/344T/366E/368D/395 D, 11M/55K/69I/ 165R/173V/189L/219V/283H/290Q/304R/344T/366E/ 368D, 5H/11M/55K/69I/165R/173V/189L/219V/263G/ 283H/290Q/304R/344T/366E/368D, 7E/11M/55K/69I/ 165R/173V/189L/219V/240R/263G/283H/290Q/304R/ 344T/366E/368D, 11M/55K/69I/141E/165R/173V/189L/ 219V/263G/283H/290Q/304R/344T/366E/368D, 11M/ 55K/69I/165R/173V/189L/219V/240R/263G/283H/290Q/ 304R/366E/368D, 5H/11M/55K/69I/127K/149D/165R/ 173V/189L/219V/240R/263G/283H/290Q/304R/366E/ 368D/395D, 11M/55K/69I/165R/173V/189L/219V/263G/ 283H/290Q/304R/366E/368D, 5H/7E/11M/55K/69I/149D/ 165R/173V/189L/219V/263G/283H/290Q/304R/344T/ 366E/368D, 7E/11M/55K/69I/165R/173V/189L/219V/ 263G/272S/283H/290Q/304R/344T/366E/368D, 7E/11M/ 55K/69I/165R/173V/178A/189L/219V/240R/263G/283H/ 290Q/304R/344T/366E/368D, 5H/11M/55K/69I/165R/ 173V/189L/219V/240R/263G/283H/290Q/304R/344T/ 366E/368D, 11M/55K/69I/165R/173V/189L/219V/263G/ 283H/290Q/304R/344T/366E/368D/395D, 3P/11M/55K/ 69I/141E/165R/173V/189L/219V/263G/283H/290Q/304R/ 344T/366E/368D/395D, 7E/11M/55K/69I/127K/165R/ 173V/189L/219V/240R/263G/283H/290Q/304R/344T/ 366E/368D, 5H/7E/11M/55K/69I/165R/173V/189L/219V/ 263G/283H/290Q/304R/344T/366E/368D, 11M/55K/69I/ 165R/173V/189L/219V/263G/283H/290Q/304R/366E/ 368D/395D, 11M/55K/69I/141E/165R/173V/189L/219V/ 263G/279F/283H/290Q/304R/344T/366E/368D/, 11M/ 54R/55K/57Y/69I/165R/173V/189L/219V/263G/283H/ 290Q/304R/366E/368D, 7E/11M/41E/55K/69I/149D/165R/ 173V/189L/219V/263G/283H/290Q/304R/366E/368D, 7E/11M/55K/69I/165R/173V/189L/219V/240R/263G/ 272S/283H/290Q/304R/344T/366E/368D/395D, 11M/55K/ 69I/165R/173V/189L/219V/240R/283H/290Q/304R/344T/ 366E/368D, 11M/55K/69I/141E/149D/165R/173V/189L/ 219V/263G/283H/290Q/304R/366E/368D, 5H/7E/11M/ 54R/55K/57Y/69I/165R/173V/189L/219V/263G/283H/ 290Q/304R/366E/368D, 5H/11M/41E/55K/69I/165R/ 173V/189L/219V/263G/272S/279F/283H/290Q/304R/ 344T/366E/368D, 7E/11M/54R/55K/69I/127K/165R/173V/ 189L/219V/228A/240R/263G/283H/290Q/298P/304R/ 366E/368D, 5H/11M/55K/69I/165R/173V/189L/219V/ 240R/263G/272S/283H/290Q/298P/304R/366E/368D, 11M/55K/69I/149D/165R/173V/189L/219V/263G/283H/ 290Q/304R/366E/368D, 3P/11M/55K/57Y/69I/165R/189L/ 219V/263G/283H/290Q/304R/344T/366E/368D, 11M/ 55K/69I/141E/165R/173V/189L/219V/272S/283H/290Q/ 304R/366E/368D, or 11M/55K/57Y/69I/141E/165R/173V/ 189L/219V/263G/283H/290Q/304R/366E/368D, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/55/57/69/141/ 165/173/189/219/240/263/283/290/304/366/368, 11/55/57/ 69/141/165/173/189/219/270/276/283/290/304/366/368, 11/55/57/69/141/165/173/189/219/263/283/290/304/335/ 366/368, 11/55/57/69/141/165/173/189/219/263/283/290/ 304/341/366/368, 11/23/55/57/69/141/165/173/189/219/ 263/283/290/304/341/366/368, 11/55/57/69/141/165/173/ 189/219/223/255/263/283/290/304/366/368, 11/23/55/57/ 69/141/165/173/189/219/239/240/255/263/276/279/283/ 290/298/304/324/366/368, 11/55/57/69/141/165/173/189/ 219/240/263/279/283/290/304/366/368, 11/55/57/69/141/ 165/173/189/219/240/263/283/290/298/304/366/368, 11/23/55/57/69/141/165/173/189/219/239/255/263/276/ 279/283/290/304/335/341/366/368, 11/55/57/69/141/165/ 173/189/219/239/240/255/263/276/283/290/298/304/316/ 335/366/368, 11/23/55/57/69/141/165/173/189/219/223/ 263/276/283/288/290/298/301/304/365/366/368, 11/55/57/ 69/141/165/173/189/219/263/283/290/298/301/304/366/ 368, 11/23/55/57/69/141/165/173/189/219/240/255/263/ 276/283/290/304/324S/335I/366/368, 11/55/57/69/141/165/ 173/189/219/263/276/283/290/304/335/366/368, 11/23/55/ 57/69/141/165/173/189/219/240/263/276/279/283/290/298/ 304/366/368, 11/55/57/69/141/165/173/189/219/263/276/ 283/290/304/341/366/368, 11/55/57/69/141/165/173/189/ 219/263/279/283/290/304/341/366/368, 11/55/57/69/141/ 165/173/189/219/229/255/263/276/282/283/290/304/341/ 366/368, 11/55/57/69/141/165/173/189/219/263/283/290/ 298/304/341/366/368, 11/23/55/57/69/141/165/173/189/ 219/240/255/263/279/283/290/304/366/368, 11/55/57/69/ 141/165/173/189/219/223/229/263/279/283/290/304/335/ 366/368, 11/23/55/57/69/141/165/173/189/219/240/263/ 276/283/290/298/304/324/366/368, 11/55/57/69/141/165/ 173/189/219/239/240/263/276/283/290/304/316/366/368, 11/23/55/57/69/141/165/173/189/219/240/263/276/279/ 283/290/304/366/368, 11/55/57/69/141/165/173/189/219/ 239/240/263/276/283/290/304/341/366/368, 11/23/55/57/ 69/141/165/173/189/219/240/263/276/283/290/298/304/ 366/368, 11/55/57/69/141/165/173/189/219/223/240/263/ 279/283/290/304/366/368, 11/23/55/57/69/141/165/173/ 189/219/255/263/276/283/290/298/304/366/368, 11/55/57/ 69/141/165/173/189/219/223/263/276/283/290/298/304/ 341/366/368/396, 11/23/55/57/69/141/165/173/189/219/ 276/279/282/283/290/298/304/341/366/368, 11/55/57/69/ 141/165/173/189/219/239/263/279/283/290/298/304/335/ 341/366/368, 11/23/55/57/69/141/165/173/189/219/263/ 276/283/290/298/304/324/335/366/368, 11/55/57/69/141/ 165/173/189/219/240/263/276/279/283/290/304/366/368, 11/55/57/69/141/165/173/189/219/263/276/279/283/290/ 298/301/304/366/368, 11/23/55/57/69/141/165/173/189/ 219/263/276/282/283/290/304/335/366/368, 11/55/57/69/ 141/165/173/189/219/263/276/279/283/290/298/304/316/ 366/368, 11/23/55/57/69/141/165/173/189/219/263/279/ 282/283/290/304/335/366/368/396, 11/23/55/57/69/141/ 165/173/189/219/263/276/283/290/298/304/324/366/368, 11/55/57/69/141/165/173/189/219/223/263/276/283/290/ 304/335/366/368, 11/55/57/69/141/165/173/189/219/263/ 276/279/282/283/290/304/366/368, 11/55/57/69/141/165/ 173/189/219/240/263/276/283/290/304/335/366/368, 11/23/55/57/69/141/165/173/189/219/239/263/283/290/ 304/341/366/368, 11/23/55/57/69/141/165/173/189/219/ 263/276/283/290/298/304/366/368, 11/55/57/69/141/165/ 173/189/219/239/263/279/283/290/304/341/366/368, 11/55/57/69/141/165/173/189/219/263/276/279/283/290/ 304/324/335/341/366/368, 11/55/57/69/141/165/173/189/ 219/263/276/283/290/298/304/324/335/366/368, 11/23/55/ 57/69/141/165/173/189/219/263/279/283/290/304/335/366/ 368, 11/55/57/69/141/165/173/189/219/255/263/283/290/ 298/304/341/366/368, 11/23/55/57/69/141/165/173/189/ 219/263/276/283/290/304/341/366/368, 11/55/57/69/141/ 165/173/189/219/223/263/283/290/304/335/365/366/368, 11/23/55/57/69/141/165/173/189/219/263/283/290/298/ 304/341/366/368, or 11/55/57/69/141/165/173/189/219/ 263/276/283/290/304/335/341/366/368, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 11M/55K/57Y/69I/ 141E/165R/173V/189L/219V/263G/276I/283H/290Q/ 304R/341F/366E/368D, 11M/55K/57Y/69I/141E/165R/ 173V/189L/219V/240R/263G/283H/290Q/298K/304R/ 366E/368D, 11M/55K/57Y/69I/141E/165R/173V/189L/ 219V/239K/240R/263G/276I/283H/290Q/304R/341F/ 366E/368D, 11M/55K/57Y/69I/141E/165R/173V/189L/ 219L/263G/276I/283H/290Q/304R/335I/366E/368D, 11M/ 23K/55K/57Y/69I/141E/165R/173V/189L/219V/240R/ 255V/263G/279F/283H/290Q/304R/366E/368D, 11M/55K/ 57Y/69I/141E/165R/173V/189L/219V/263G/276I/283H/ 290Q/304R/335I/341F/366E/368D, 11M/55K/57Y/69I/ 141E/165R/173V/189L/219L/240R/263G/283H/290Q/ 304R/366E/368D, 11M/55K/57Y/69I/141E/165R/173V/ 189L/219V/263G/279F/283H/290Q/304R/341F/366E/ 368D, 11M/23K/55K/57Y/69I/141E/165R/173V/189L/ 219L/263G/276I/283H/290Q/298K/304R/366E/368D, 11M/55K/57Y/69I/141E/165R/173V/189L/219V/263G/ 283H/290Q/304R/341F/366E/368D, 11M/23K/55K/57Y/ 69I/141E/165R/173V/189L/219L/263G/283H/290Q/298K/ 304R/341F/366E/368D, 11M/23K/55K/57Y/69I/141E/ 165R/173V/189L/219V/240R/255V/263G/276I/283H/ 290Q/304R/324S/335I/366E/368D, 11M/55K/57Y/69I/ 141E/165R/173V/189L/219V/263G/283H/290Q/298P/ 304R/341F/366E/368D, 11M/55K/57Y/69I/141E/165R/ 173V/189L/219V/263G/276I/279F/283H/290Q/304R/ 324S/335I/341F/366E/368D, 11M/55K/57Y/69I/141E/ 165R/173V/189L/219V/263G/283H/290Q/304R/335I/ 366E/368D, 11M/55K/57Y/69I/141E/165R/173V/189L/ 219L/240R/263G/276I/283H/290Q/304R/335I/366E/368D, 11M/55K/57Y/69I/141E/165R/173V/189L/219V/255V/ 263G/283H/290Q/298K/304R/341F/366E/368D, 11M/55K/ 57Y/69I/141E/165R/173V/189L/219L/263G/279F/283H/ 290Q/304R/341F/366E/368D, 11M/55K/57Y/69I/141E/ 165R/173V/189L/219V/239K/263G/279F/283H/290Q/ 304R/341F/366E/368D, 11M/23K/55K/57Y/69I/141E/ 165R/173V/189L/219V/263G/276I/283H/290Q/298K/ 304R/324S/366E/368D, 11M/23K/55K/57Y/69I/141E/ 165R/173V/189L/219V/239K/255V/263G/276I/279F/ 283H/290Q/304R/335I/341F/366E/368D, 11M/55K/57Y/ 69I/141E/165R/173V/189L/219L/263G/276I/283H/290Q/ 298K/304R/324S/335I/366E/368D, 11M/55K/57Y/69I/ 141E/165R/173V/189L/219V/239K/240R/263G/276I/ 283H/290Q/304R/316L/366E/368D, 11M/55K/57Y/69I/ 141E/165R/173V/189L/219V/240R/263G/283H/290Q/ 304R/366E/368D, 11M/55K/57Y/69I/141E/165R/173V/ 189L/219V/263G/276I/283H/290Q/298K/304R/324S/335I/ 366E/368D, 11M/23K/55K/57Y/69I/141E/165R/173V/ 189L/219L/239K/263G/283H/290Q/304R/341F/366E/ 368D, 11M/23K/55K/57Y/69I/141E/165R/173V/189L/ 219V/263G/283H/290Q/304R/341F/366E/368D, 11M/23K/ 55K/57Y/69I/141E/165R/173V/189L/219V/255V/263G/ 276I/283H/290Q/298K/304R/366E/368D, 11M/23K/55K/ 57Y/69I/141E/165R/173V/189L/219L/263G/276I/283H/ 290Q/304R/341F/366E/368D, 11M/23K/55K/57Y/69I/ 141E/165R/173V/189L/219V/263G/276I/283H/290Q/ 298K/304R/324S/335I/366E/368 D, 11M/55K/57Y/69I/ 141E/165R/173V/189L/219V/239K/240R/255V/263G/ 276I/283H/290Q/298P/304R/316L/335I/366E/368D, 11M/ 23K/55K/57Y/69I/141E/165R/173V/189L/219V/240R/ 263G/276I/283H/290Q/298K/304R/366E/368D, 11M/55K/ 57Y/69I/141E/165R/173V/189L/219V/240R/263G/279F/ 283H/290Q/304R/366E/368D, 11M/23K/55K/57Y/69I/ 141E/165R/173V/189L/219V/263G/279F/283H/290Q/ 304R/335I/366E/368D, 11M/23K/55K/57Y/69I/141E/ 165R/173V/189L/219L/240R/263G/276I/283H/290Q/ 298K/304R/324S/366E/368D, 11M/23K/55K/57Y/69I/ 141E/165R/173V/189L/219L/240R/263G/276I/279F/283H/ 290Q/298K/304R/366E/368D, 11M/55K/57Y/69I/141E/ 165R/173V/189L/219V/263G/276I/279F/283H/290Q/ 298P/304R/316L/366E/368D, 11M/55K/57Y/69I/141E/ 165R/173V/189L/219V/239K/263G/279F/283H/290Q/ 298K/304R/335I/341F/366E/368D, 11M/23K/55K/57Y/ 69I/141E/165R/173V/189L/219V/239K/240R/255V/263G/ 276I/279F/283H/290Q/298P/304R/324S/366E/368D, 11M/ 55K/57Y/69I/141E/165R/173V/189L/219V/240R/263G/ 276I/279F/283H/290Q/304R/366E/368D, 11M/23K/55K/ 57Y/69I/141E/165R/173V/189L/219V/263G/279F/282A/ 283H/290Q/304R/335I/366E/368D/396V, 11M/55K/57Y/ 69I/141E/165R/173V/189L/219V/263G/283H/290Q/298P/ 301Q/304R/366E/368D, 11M/55K/57Y/69I/141E/165R/ 173V/189L/219L/223I/263G/276I/283H/290Q/304R/335I/ 366E/368D, 11M/55K/57Y/69I/141E/165R/173V/189L/ 219L/263G/276I/279F/283H/290Q/298K/301Q/304R/ 366E/368D, 11M/55K/57Y/69I/141E/165R/173V/189L/ 219V/223I/229S/263G/279F/283H/290Q/304R/335I/366E/ 368D, 11M/55K/57Y/69I/141E/165R/173V/189L/219V/ 223I/255V/263G/283H/290Q/304R/366E/368D, 11M/55K/ 57Y/69I/141E/165R/173V/189L/219L/263G/276I/279F/ 282A/283H/290Q/304R/366E/368D, 11M/55K/57Y/69I/ 141E/165R/173V/189L/219V/229S/255V/263G/276I/ 282A/283H/290Q/304R/341F/366E/368D, 11M/55K/57Y/ 69I/141E/165R/173V/189L/219V/223I/263G/283H/290Q/ 304R/335I/365K/366E/368D, 11M/55K/57Y/69I/141E/ 165R/173V/189L/219L/223I/263G/276I/283H/290Q/298P/ 304R/341F/366E/368D/396V, 11M/55K/57Y/69I/141E/ 165R/173V/189L/219V/270S/276I/283H/290Q/304R/ 366E/368D, 11M/23K/55K/57Y/69I/141E/165R/173V/ 189L/219V/263G/276I/282A/283H/290Q/304R/335I/366E/ 368D, 11M/23K/55K/57Y/69I/141E/165R/173V/189L/ 219V/276I/279F/282A/283H/290Q/298K/304R/341F/ 366E/368D, 11M/23K/55K/57Y/69I/141E/165R/173V/ 189L/219L/223I/263G/276I/283H/288I/290Q/298K/301Q/ 304R/365K/366E/368D, 11M/23K/55K/57Y/69I/141E/ 165R/173V/189L/219L/240R/263G/276I/279F/283H/ 290Q/304R/366E/368D, or 11M/55K/57Y/69I/141E/165R/ 173V/189L/219L/223I/240R/263G/279F/283H/290Q/ 304R/366E/368D, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/23/55/57/69/ 141/165/173/189/219/263/275S/276/283/290/304/341/366/ 368, 11/23/55S/57/69/141/165/173/189/219/263/276/283/ 290/304/341/366/368, 11/23/55/57/69/141/165/173/189/ 219/223/239/240/263/276/279/283/290/304/335/341/366/ 368, 11/23/55/57/69/141/165/173/189/219/223/239/240/ 263/276/283/290/304/341/366/368, 11/23/55/57/69/141/ 165/173/189/219/223/239/255/263/276/283/290/304/316/ 341/366/368, 11/23/55/57/69/141/165/173/189/219/223/ 239/263/276/283/290/298/304/316/341/366/368, 11/23/55/ 57/69/141/165/173/189/219/223/240/263/276/283/290/298/ 304/341/366/368, 11/23/55/57/69/132/141/165/173/189/ 219/263/276/283/290/304/341/366/368, 11/23/55/57/69/ 134/141/165/173/189/219/263/276/283/290/304/341/366/ 368, 11/23/55/57/69/141/165/173/189/219/223/239/263/ 276/283/290/304/316/335/341/366/368, 11/23/55/57/69/ 141/165/173/189/219/223/255/263/276/283/290/298/304/ 316/341/366/368, 11/23/55/57/69/141/165/173/189/219/ 223/255/263/276/283/290/298/304/341/366/368, 11/23/55/ 57/69/141/145/165/173/189/219/263/276/283/290/304/341/ 366/368, 11/23/55/57/69/141/165/173/189/219/223/239/ 263/276/283/290/304/341/366/368, 11/23/55/57/69/141/ 165/173/189/219/223/263/276/279/283/290/298/304/335/ 341/366/368, 11/23/55/57/69/141/165/173/189/219/223/ 263/276/279/283/290/298/304/341/366/368, 11/23/55/57/ 69/141/165/173/189/219/223/255/263/276/283/290/304/ 335/341/366/368, 11/23/55/57/69/141/165/173/189/219/ 223/263/276/283/288/290/298/304/341/366/368, 11/23/55/ 57/69/141/165/173/189/219/223/255/263/276/283/290/304/ 341/366/368, 11/23/55/57/69/141/165/173/189/219/239/ 263/276/279/283/290/298/304/316/341/366/368, 11/23/55/ 57/69/141/165/173/189/219/223/263/276/279/283/290/304/ 335/341/366/368, 11/23/55/57/69/141/165/173/189/219/ 240/255/263/276/283/290/304/341/366/368, 11/23/55/57/ 69/141/165/173/189/219/263/276/283/290/304/341/ 366/368, 11/17/23/55/57/69/141/165/173/189/219/263/276/ 283/290/304/341/366/368, 11/23/55/57/69/141/165/173/ 174/189/219/263/276/283/290/304/341/366/368, 11/23/55/ 57/69/141/165/173/189/219/223/263/276/283/288/290/304/ 341/366/368, 11/23/55/57/69/141/165/173/179/189/219/ 263/276/283/290/304/341/366/368, 11/23/55/57/69/141/ 165/173/189/219/223/263/276/283/290/298/304/341/366/ 368, 11/23/55/57/69/141/165/173/189/219/240/263/276/ 279/283/290/304/341/366/368, 11/23/55/57/69/141/165/ 173/189/219/240/263/276/283/288/290/304/335/341/366/ 368, 11/23/55/57/69/141/165/173/189/219/239/263/276/ 283/288/290/304/341/366/368, 11/23/55/57/69/141/165/ 173/189/219/223/263/276/283/290/304/316/341/366/368, 11/23/55/57/69/141/165/173/189/219/255/263/276/279/ 283/290/304/341/366/368, 11/23/55/57/69/141/165/173/ 189/219/223/263/276/283/290/304/335/341/366/368, 11/23/55/57/69/141/165/173/189/219/255/263/276/283/ 290/298/304/341/366/368, 11/23/55/57/69/141/165/173/ 189/219/223/263/276/283/290/304/341/366/368, 11/23/55/ 57/69/141/165/173/189/219/263/276/279/283/290/298/304/ 335/341/366/368, 11/23/55/57/69/141/165/173/189/219/ 236/263/276/283/290/304/341/366/368, 11/23/55/57/69/ 141/165/173/189/219/255/263/276/283/290/304/335/341/ 366/368, 11/23/55/57/69/141/165/173/189/219/237/263/ 276/283/290/304/341/366/368, 11/23/55/57/69/141/165/ 173/189/219/239/263/276/283/290/304/341/366/368, 11/23/55/57/69/141/165/173/189/219/255/263/276/283/ 290/304/341/366/368, 11/23/55/57/69/141/165/173/189/ 219/263/267/276/283/290/304/341/366/368, 11/23/55/57/ 69/141/165/173/189/219/263/275/276/283/290/304/341/ 366/368, 11/23/55/57/69/141/165/173/189/219/263/276/ 283/290/298/304/335/341/366/368, 11/23/55/57/69/141/ 165/173/189/219/263/276/279/283/290/304/341/366/368, 11/23/55/57/69/141/165/173/189/219/263/276/283/287/ 290/304/341/366/368, 11/23/55/57/69/141/165/173/189/ 219/263/276/283/288/290/304/341/366/368, 11/23/55/57/ 69/141/165/173/189/219/263/276/283/290/295/304/341/ 366/368, 11/23/55/57/69/141/165/173/189/219/263/276/ 283/290/298/304/341/366/368, 11/23/55/57/69/141/165/ 173/189/219/263/276/283/290/304/309/341/366/368, 11/23/55/57/69/141/165/173/189/219/263/276/283/290/ 304/316/341/366/368, 11/23/55/57/69/141/165/173/189/ 219/263/276/283/290/304/322/341/366/368, 11/23/55/57/ 69/141/165/173/189/219/263/276/283/290/304/333/341/ 366/368, 11/23/55/57/69/141/165/173/189/219/263/276/ 283/290/304/341/358/366/368, 11/23/55/57/69/141/165/ 173/189/219/263/276/283/290/304/341/366/368, 11/23/55/ 57/69/141/165/173/189/219/263/276/283/290/304/341/366/ 368/383, 11/23/47/55/57/69/141/165/173/189/219/263/276/ 283/290/304/341/366/368, 11/23/50/55/57/69/141/165/173/ 189/219/263/276/283/290/304/341/366/368, 5/11/23/55/57/ 69/141/165/173/189/219/263/276/283/290/304/341/366/ 368, 7/11/23/55/57/69/141/165/173/189/219/263/276/283/ 290/304/341/366/368, 11/23/55/57/69/141/A145S/165/173/ 189/219/263/276/283/290/304/341/366/368, 11/23/55E/57/ 69/141/165/173/189/219/263/276/283/290/304/341/366/ 368, 2/11/23/55/57/69/141/165/173/189/219/263/276/283/ 290/304/341/366/368, 3/11/23/55/57/69/141/165/173/189/ 219/263/276/283/290/304/341/366/368, 4/11/23/55/57/69/ 141/165/173/189/219/263/276/283/290/304/341/366/368, or 8/11/23/55/57/69/141/165/173/189/219/263/276/283/ 290/304/341/366/368, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 11M/23K/55K/57Y/69I/141E/ 165R/173V/189L/219L/255V/263G/276I/283H/290Q/ 304R/341F/366E/368D, 11M/23K/55K/57Y/69I/141E/ 165R/173V/189L/219L/223I/239K/240R/263G/276I/279F/ 283H/290Q/304R/335 I/341F/366E/368D, 11M/23K/55K/ 57Y/69I/141E/165R/173V/189L/219L/240R/263G/276I/ 279F/283H/290Q/304R/341F/366E/368 D, 11M/23K/55K/ 57Y/69I/141E/165R/173V/189L/219L/263G/276I/283H/ 290Q/298K/304R/335I/341F/366E/368 D, 11M/23K/55K/ 57Y/69I/141E/165R/173V/189L/219L/223I/263G/276I/ 279F/283H/290Q/298S/304R/335I/341F/366E/368D, 11M/ 23K/55K/57Y/69I/141E/165R/173V/189L/219L/223I/ 255V/263G/276I/283H/290Q/298K/304R/316L/341F/ 366E/368D, 11M/23K/55K/57Y/69I/141E/165R/173V/ 189L/219L/223I/263G/276I/283H/290Q/304R/341F/366E/ 368D, 11M/23K/55K/57Y/69I/141E/165R/173V/189L/ 219L/223I/239K/240R/263G/276I/283H/290Q/304R/341F/ 366E/368D, 11M/23K/55K/57Y/69I/141E/165R/173V/ 189L/219L/223I/263G/276I/283H/288I/290Q/304R/341F/ 366E/368 D, 11M/23K/55K/57Y/69I/141E/165R/173V/ 189L/219L/223I/239K/263G/276I/283H/290Q/304R/341F/

366E/368 D, 11M/23K/55K/57Y/69I/141E/165R/173V/ 189L/219L/263G/276I/283H/288I/290Q/304R/341F/366E/ 368D, 11M/23K/55K/57Y/69I/141E/165R/173V/189L/ 219L/223I/255V/263G/276I/283H/290Q/304R/341F/366E/ 368 D, 11M/23K/55K/57Y/69I/141E/165R/173V/189L/ 219L/223I/240R/263G/276I/283H/290Q/298S/304R/341F/ 366E/368D, 11M/23K/55K/57Y/69I/141E/165R/173V/ 189L/219L/263G/276I/279F/283H/290Q/298K/304R/335I/ 341F/366E/368D, 11M/23K/55K/57Y/69I/141E/165R/ 173V/189L/219L/223I/263G/276I/283H/288I/290Q/298K/ 304R/341F/366E/368D, 11M/23K/55K/57Y/69I/141E/ 165R/173V/189L/219L/255V/263G/276I/283H/290Q/ 304R/335I/341F/366E/368 D, 11M/23K/55K/57Y/69I/ 141E/165R/173V/189L/219L/239K/263G/276I/283H8I/ 290Q/304R/3411F/3668 D, 11M/23K/55K/57Y/69I/141E/ 165R/173V/189L/219L/223I/255V/263G/276I/283H/290Q/ 298K/304R/341F/366E/368D, 11M/23K/55K/57Y/69I/ 141E/165R/173V/189L/219L/2633G/276I/279F/283H/ 290Q/304R/341F/366E/368D, 11M/23K/55K/57Y/69I/ 141E/165R/173V/189L/219L/263G/276I/283H/290Q/ 298K/304R/341F/366E/368D, 11M/23K/55K/57Y/69I/ 141E/165R/173V/189L/219L/255V/263G/276I/279F/ 283H/290Q/304R/341F/366E/368 D, 11M/23K/55K/57Y/ 69I/141E/165R/173V/189L/219L/223I/263G/26I/2769F/ 283H/290Q/304R/335I/341F/366E/368D, 11M/23K/55K/ 57Y/69I/141E/165R/173V/189L/219L/223I/255V/263G/ 276I/283H/290Q/304R/335I/341F/366E/368D, 11M/23K/ 55K/57Y/69I/141E/165R/173V/189L/219L/255V/263G/ 276I/283H/290/290Q/298P/304R/366E/368 D, 11M/23K/ 55K/57Y/69I/141E/165R/173V/189L/219L/239K/263G/ 276I/279F/283H/290Q/298K/304R/316L/341F/366E/368D, 11M/23K/55K/57Y/69I/141E/165R/173V/189L/219L/223I/ 239K/263G/276I/283H/290Q/304R/316L/335I/341F/366E/ 368D, 11M/23K/55K/57Y/69I/141E/165R/173V/189L/ 219L/240R/255V/263G/276I/283H/290Q/304R/341F/ 366E/368D, 11M/23K/55K/57Y/69I/141E/165R/173V/ 189L/219L/223I/263G/276I/283H/290Q/298S/304R/341F/ 366E/368 D, 11M/23K/55K/57Y/69I/141E/165R/173V/ 189L/219L/223I/263G/276I/283H/290Q/304R/335I/341F/ 366E/368 D, 11M/23K/55K/57Y/69I/141E/165R/173V/ 189L/219L/223I/263G/276I/279F/283H/290Q/298S/304R/ 341F/366E/368D, 11M/23K/55K/57Y/69I/141E/165R/ 173V/189L/219L/223I/239K/263G/276I/283H/290Q/298K/ 304R/316L/341F/366E/368D, 11M/23K/55K/57Y/69I/ 141E/165R/173V/189L/219L/223I/23G/276I/283H/290Q/ 304R/316L/341F/366E/368D, 11M/23K/55K/57Y/69I/ 141E/165R/173V/189L/219L/263G/276I/283H/290Q/ 304R/316L/341F/366E/368D, 11M/23K/55K/57Y/69I/ 141E/165R/173V/189L/219L/223I/239K/255V/263 G/276I/283H/290Q/304R/316L/341F/366E/368D, 11M/ 23K/55K/57Y/69I/141E/165R/173V/189L/219L/240R/ 263G/276I/283H/288I/290Q/304R/335I/341F/366 E/368D, 11M/23K/55K/57Y/69I/141E/165R/173V/189L/219L/ 239K/263G/276I/283H/290Q/304R/341F/366E/368D, 5T/11M/23K/55K/57Y/69I/141E/165R/173V/189L/219L/ 263G/276I/283H/290Q/304R/341F/366E/368D, 11M/17C/ 23K/55K/57Y/69I/141E/165R/173V/189L/219L/263G/ 276I/283H/290Q/304R/341F/366E/368D, 11M/23K/55K/ 57Y/69I/134F/141E/165R/173V/189L/219L/263G/276I/ 283H/290Q/304R/341F/366E/368D, 7L/11M/23K/55K/ 57Y/69I/141E/165R/173V/189L/219L/263G/276I/283H/ 290Q/304R/341F/366E/368D, 8P/11M/23K/55K/57Y/69I/ 141E/165R/173V/189L/219L/263G/276I/283H/290Q/ 304R/341F/366E/368D, 7S/11M/23K/55K/57Y/69I/141E/ 165R/173V/189L/219L/263G/276I/283H/290Q/304R/ 341F/366E/368D, 11M/23K/55K/57Y/69I/141E/165R/ 170G/173V/189L/219L/263G/276I/283H/290Q/304R/ 341F/366E/368D, 11M/23K/55K/57Y/69I/132V/141E/ 165R/173V/189L/219L/263G/276I/283H/290Q/304R/ 341F/366E/368D, 11M/23K/55N/57Y/69I/141E/165R/ 173V/189L/219L/263G/276I/283H/290Q/304R/341F/ 366E/368D, 11M/23K/55K/57Y/69I/141E/A145S/165R/ 173V/189L/219L/263G/276I/283H/290Q/304R/341F/ 366E/368D, 4E/11M/23K/55K/57Y/69I/141E/165R/173V/ 189L/219L/263G/276I/283H/290Q/304R/341F/366E/ 368D, 3E/11M/23K/55K/57Y/69I/141E/165R/173V/189L/ 219L/263G/276I/283H/290Q/304R/341F/366E/368D, 11M/ 23K/50M/55K/57Y/69I/141E/165R/173V/189L/219L/ 263G/276I/283H/290Q/304R/341F/366E/368D, 2W/11M/ 23K/55K/57Y/69I/141E/165R/173V/189L/219L/263G/ 276I/283H/290Q/304R/341F/366E/368D, 11M/23K/55E/ 57Y/69I/141E/165R/173V/189L/219L/263G/276I/283H/ 290Q/304R/341F/366E/368D, 11M/23K/55K/57Y/69I/ 141E/145G/165R/173V/189L/219L/263G/276I/283H/ 290Q/304R/341F/366E/368D, 8G/11M/23K/55K/57Y/69I/ 141E/165R/173V/189L/219L/263G/276I/283H/290Q/ 304R/341F/366E/368D, 2K/11M/23K/55K/57Y/69I/141E/ 165R/173V/189L/219L/263G/276I/283H/290Q/304R/ 341F/366E/368D, 11M/23K/47Q/55K/57Y/69I/141E/165R/ 173V/189L/219L/263G/276I/283H/290Q/304R/341F/ 366E/368D, 3S/11M/23K/55K/57Y/69I/141E/165R/173V/ 189L/219L/263G/276I/283H/290Q/304R/341F/366E/ 368D, 11M/23K/55S/57Y/69I/141E/165R/173V/189L/ 219L/263G/276I/283H/290Q/304R/341F/366E/368D, 4V/11M/23K/55K/57Y/69I/141E/165R/173V/189L/219L/ 263G/276I/283H/290Q/304R/341F/366E/368D, 11M/23K/ 55K/57Y/69I/141E/165R/170Q/173V/189L/219L/263G/ 276I/283H/290Q/304R/341F/366E/368D, 11M/23K/55K/ 57Y/69I/141E/165R/173V/174E/189L/219L/263G/276I/ 283H/290Q/304R/341F/366E/368D, 11M/23K/55P/57Y/ 69I/141E/165R/173V/189L/219L/263G/276I/283H/290Q/ 304R/341F/366E/368D, 8S/11M/23K/55K/57Y/69I/141E/ 165R/173V/189L/219L/263G/276I/283H/290Q/304R/ 341F/366E/368D, 11M/23K/55K/57Y/69I/141E/165R/ 173V/189L/219L/263G/276I/283H/287D/290Q/304R/ 341F/366E/368D, 11M/23K/55K/57Y/69I/141E/165R/ 173V/189L/219L/263G/267N/276I/283H/290Q/304R/ 341F/366E/368D, 11M/23K/55K/57Y/69I/141E/165R/ 173V/189L/219L/237Y/263G/276I/283H/290Q/304R/ 341F/366E/368D, 11M/23K/55K/57Y/69I/141E/165R/ 173V/189L/219L/237R/263G/276I/283H/290Q/304R/ 341F/366E/368D, 11M/23K/55K/57Y/69I/141E/165R/ 173V/189L/219L/263G/276I/283H/290K/295S/304R/341F/ 366E/368D, 11M/23K/55K/57Y/69I/141E/165R/173V/ 189L/219L/263G/275S/276I/283H/290Q/304R/341F/366E/ 368D, 11M/23K/55K/57Y/69I/141E/165R/173V/189L/ 219L/237H/263G/276I/283H/290Q/304R/341F/366E/ 368D, 11M/23K/55K/57Y/69I/141E/165R/173V/179W/ 189L/219L/263G/276I/283H/290Q/304R/341F/366E/ 368D, 11M/23K/55K/57Y/69I/141E/165R/173V/189L/ 219L/263G/276I/283H/290Q/295E/304R/341F/366E/ 368D, 11M/23K/55K/57Y/69I/141E/165R/173V/189L/ 219L/263G/276I/283H/290Q/304R/309K/341F/366E/ 368D, 11M/23K/55K/57Y/69I/141E/165R/173V/189L/ 219L/263G/276I/283H/290Q/304R/333T/341F/366E/ 368D, 11M/23K/55K/57Y/69I/141E/165R/173V/189L/ 219L/237G/263G/276I/283H/290Q/304R/341F/366E/ 368D, 11M/23K/55K/57Y/69I/141E/165R/173V/189L/ 219L/263G/276I/283H/290Q/304R/341F/358K/366E/ 368D, 11M/23K/55K/57Y/69I/141E/165R/173V/189L/ 219L/263G/276I/283H/290Q/304R/341F/358R/366E/ 368D, 11M/23K/55K/57Y/69I/141E/165R/173V/189L/ 219L/263G/276I/283H/290Q/304R/309A/341F/366E/ 368D, 11M/23K/55K/57Y/69I/141E/165R/173V/189L/

219L/263G/276I/283H/290Q/304R/341F/358C/366E/ 368D, 11M/23K/55K/57Y/69I/141E/165R/173V/189L/ 219L/263G/275R/276I/283H/290Q/304R/341F/366E/ 368D, 11M/23K/55K/57Y/69I/141E/165R/173V/189L/ 219L/263G/267R/276I/283H/290Q/304R/341F/366E/ 368D, 11M/23K/55K/57Y/69I/141E/165R/173V/189L/ 219L/263G/276I/283H/290Q/304R/322V/341F/366E/ 368D, 11M/23K/55K/57Y/69I/141E/165R/173V/189L/ 219L/263G/276I/283H/290Q/304R/341F/366E/368D/383I, 11M/23K/55K/57Y/69I/141E/165R/173V/189L/219L/ 237A/263G/276I/283H/290Q/304R/341F/366E/368D, 11M/23K/55K/57Y/69I/141E/165R/173V/189L/219L/ 237K/263G/276I/283H/290Q/304R/341F/366E/368D, 11M/23K/55K/57Y/69I/141E/165R/173V/189L/219L/ 237L/263G/276I/283H/290Q/304R/341F/366E/368D, 11M/ 23K/55K/57Y/69I/141E/165R/173V/189L/219L/236R/ 263G/276I/283H/290Q/304R/341F/366E/368D, or 11M/ 23K/55K/57Y/69I/141E/165R/173V/189L/219L/237V/ 263G/276I/283H/290Q/304R/341F/366E/368D, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 11/23/55/57/69/ 141/165/173/189/263/290/298/304/341/366, 55/57/69/141/ 165/173/189/219/223/263/283/290/298/304/341/366, 11/23/50/55/57/69/132/141/165/173/189/219/223/237G/ 263/267/276/279/283/290/298/304/341/366/368, 8/11/23/ 50/55/57/69/132/141/165/173/189/219/223/237/263/276/ 279/283/290/298/304/341/366/368, 11/23/55/57/69/141/ 165/189/219/223/276/279/290/298/304/341/366, 8/11/23/ 50/55/57/69/141/165/173/189/219/223/237/263/276/279/ 283/290/298/304/341/366/368, 8/11/23/50/55/57/69/141/ 165/173/189/219/223/263/276/279/283/290/298/304/341/ 366/368, 5/11/23/50/55/57/69/141/165/173/189/219/223/ 236/237/263/267/276/279/283/290/298/304/341/366/368, 5/8/11/23/55/57/69/132/141/165/173/189/219/223/236/237/ 263/276/279/283/290/298/304/341/366/368, 5/11/23/50/55/ 57/69/141/165/173/189/219/223/263/276/279/283/290/298/ 304/341/366/368, 11/23/55/57/69/132/141/165/173/189/ 219/223/236/237/263/276/279/283/290/298/304/341/366/ 368, 8/11/23/55/57/69/141/165/173/189/219/223/236/ 237G/263/276/279/283/290/298/304/341/366/368, 11/23/ 55/57/69/132/141/165/173/189/219/223/237/263/276/279/ 283/290/298/304/341/366/368, 5/8/11/23/55/57/69/141/ 165/173/189/219/223/236/237/263/267/276/279/283/290/ 298/304/341/366/368, 11/23/50/55/57/69/132/141/165/173/ 180/189/219/223/237/263/276/279/283/290/298/304/341/ 366/368, 11/23/55/57/69/132/141/165/173/189/219/223/ 263/267/276/279/283/290/298/304/341/366/368, 11/23/55/ 57/69/132/141/165/173/189/219/223/263/276/279/283/290/ 298/304/341/366/368, 8/11/23/55A/57/69/141/165/173/ 189/219/223/263/267/276/279/283/290/298/304/341/366/ 368, 5/8/11/23/50/55/57/69/132/141/165/173/189/219/223/ 263/276/279/283/290/298/304/341/366/368, 11/23/55/69/ 141/165/173/189/219/223/263/276/279/283/290/298/304/ 341/366/368, 11/23/50/55/57/69/132/141/165/173/189/219/ 223/237/263/267/276/279/283/290/298/304/341/366/368, 11/23/55/57/69/141/165/173/189/219/223/236/237/263/ 267/276/279/283/290/298/304/341/366/368, 11/23/50/55/ 57/69/132/141/165/173/189/219/223/236/263/276/279/283/ 290/298/304/341/366/368, 11/23/55/57/69/141/165/173/ 189/219/223/236/237/263/276/279/283/290/304/341/ 366/368, 23/55/57/69/141/165/173/189/219/223/263/276/ 279/283/290/298/304/341/366, 11/23/55/57/69/141/165/ 173/189/219/223/237/263/267/276/279/283/290/298/304/ 341/366/368, 11/23/55/57/69/141/165/173/189/219/223/ 236/263/276/279/283/290/298/304/341/366/368, 11/23/55/ 57/69/141/165/173/189/219/223/237/263/276/279/283/290/ 298/304/341/366/368, 11/23/55/57/69/141/165/173/189/ 219/223/263/267/276/279/283/290/298/304/341/366/368, 11/23/50/55/57/69/141/165/173/189/219/223/236/237/263/ 276/279/283/290/298/304/341/366/368, 11/23/55/57/69/ 141/165/173/189/219/223/263/276/279/290/298/304/341/ 366/368, 11/23/55/57/69/141/165/173/189/219/223/276/ 279/283/290/298/304/341/366/368, 11/23/55/57/69/141/ 165/173/189/219/263/276/279/283/290/298/304/341/366, 11/23/55/57/69/141/165/173/189/223/263/276/279/283/ 290/298/304/341/366/368, 11/23/50/55/57/69/141/165/173/ 189/219/223/263/276/279/283/290/298/304/341/366/368, 11/23/55/57/69/141/165/173/219/223/263/276/279/283/ 290/298/304/341/366, 11/55/69/165/173/189/219/263/276/ 279/283/290/298/304/341/366/368, 5/11/23/55/57/69/141/ 165/173/189/219/223/236/237/263/276/279/283/290/298/ 304/341/366/368, 5/11/23/55/57/69/132/141/165/173/189/ 219/223/263/276/279/283/290/298/304/341/366/368, 8/11/ 23/55/57/69/141/165/173/189/219/223/237/263/276/279/ 283/290/298/304/341/366/368, 8/11/23/55/57/69/141/165/ 173/189/219/223/236/237/263/267/276/279/283/290/298/ 304/341/366/368, 8/11/23/55/57/69/141/165/173/189/219/ 223/263/276/279/283/290/298/304/341/366/368, 8/11/23/ 55/57/69/141/165/173/189/219/223/236/237/263/276/279/ 283/290/298/304/341/366/368, 8/11/23/55/57/69/141/165/ 173/189/219/223/237/263/276/279/283/290/298/304/341/ 366/368, 8/11/23/55/57/69/132/141/165/173/189/219/223/ 236/263/276/279/283/290/298/304/341/366/368, 8/11/23/ 55/57/69/141/165/173/189/219/223/237/263/267/276/279/ 283/290/298/304/341/366/368, 8/11/23/55/57/69/141/165/ 173/189/219/223/263/276/279/283/290/298/304/341/366/ 368, or 5/11/23/55/57/69/141/165/173/189/219/223/263/ 276/279/283/290/298/304/341/366/368, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 5T/11M/23K/55K/ 57Y/69I/141E/165R/173V/189L/219L/223I/236R/237H/ 263G/276I/279F/283H/290Q/298S/304R/341F/366E/368D, 5T/11M/23K/55S/57Y/69I/132V/141E/165R/173V/189L/ 219L/223I/263G/276I/279F/283H/290Q/298S/304R/341F/ 366E/368D, 11M/23K/55K/57Y/69I/132V/141E/165R/ 173V/189L/219L/223I/236R/237A/263G/276I/279F/283H/ 290Q/298 S/304R/341F/366E/368D, 11M/23K/55P/57Y/ 69I/141E/165R/173V/189L/219L/223I/263G/267E/276I/ 279F/283H/290Q/298S/304R/341F/366E/368D, 5T/8S/ 11M/23K/55K/57Y/69I/141E/165R/173V/189L/219L/223I/ 236R/237H/263G/267E/276I/279F/283H/290 Q/298S/ 304R/341F/366E/368D, 8S/11M/23K/55A/57Y/69I/141E/ 165R/173V/189L/219L/223I/263G/267E/276I/279F/283H/ 290Q/298S/304R/341F/366E/368D, 5T/11M/23K/50M/ 55K/57Y/69I/141E/165R/173V/189L/219L/223I/263G/ 276I/279F/283H/290Q/298S/304R/341F/366E/368D, 5T/8S/11M/23K/55A/57Y/69I/132V/141E/165R/173V/

189L/219L/223I/236R/237T/263G/276I/279F/283H/290 Q/298S/304R/341F/366E/368D, 8S/11M/23K/55K/57Y/ 69I/141E/165R/173V/189L/219L/223I/237H/263G/276I/ 279F/283H/290Q/298S/304R/341F/366E/368D, 11M/23K/ 55K/57Y/69I/141E/165R/173V/189L/219L/223I/236R/ 237H/263G/267E/276I/279F/283H/290Q/298 S/304R/ 341F/366E/368D, 11M/23K/50M/55K/57Y/69I/132V/ 141E/165R/173V/180V/189L/219L/223I/237H/263G/276I/ 279F/283H/290 Q/298S/304R/341F/366E/368D, 11M/23K/ 55K/57Y/69I/132V/141E/165R/173V/189L/219L/223I/ 263G/276I/279F/283H/290Q/298S/304R/341F/366E/368D, 11M/23K/55P/57Y/69I/132V/141E/165R/173V/189L/ 219L/223I/237H/263G/276I/279F/283H/290Q/298S/304R/ 341F/366E/368D, 8S/11M/23K/55S/57Y/69I/141E/165R/ 173V/189L/219L/223I/236R/237K/263G/267E/276I/279F/ 283H/290Q/298S/304R/341F/366E/368D, 11M/23K/55A/ 57Y/69I/141E/165R/173V/189L/219L/223I/236R/237K/ 263G/276I/279F/283H/290Q/298S/304R/341F/366E/368D, 11M/23K/55K/57Y/69I/141E/165R/173V/189L/219L/223I/ 237H/263G/276I/279F/283H/290Q/298S/304R/341F/366E/ 368D, 11M/23K/55S/57Y/69I/132V/141E/165R/173V/ 189L/219L/223I/263G/276I/279F/283H/290Q/298S/304R/ 341F/366E/368D, 11M/23K/50M/55K/57Y/69I/141E/ 165R/173V/189L/219L/223I/263G/276I/279F/283H/290Q/ 298S/304R/341F/366E/368D, 11M/23K/55K/57Y/69I/ 141E/165R/173V/189L/219L/223I/237H/263G/267E/276I/ 279F/283H/290Q/298S/304R/341F/366E/368D, 8S/11M/ 23K/55S/57Y/69I/141E/165R/173V/189L/219L/223I/ 263G/276I/279F/283H/290Q/298S/304R/341F/366E/368D, 8S/11M/23K/55K/57Y/69I/141E/165R/173V/189L/219L/ 223I/236R/237K/263G/276I/279F/283H/290Q/298S/304R/ 341F/366E/368D, 8S/11M/23K/55K/57Y/69I/141E/165R/ 173V/189L/219L/223I/237R/263G/276I/279F/283H/290Q/ 298S/304R/341F/366E/368D, 11M/23K/50M/55K/57Y/ 69I/141E/165R/173V/189L/219L/223I/236R/237R/263G/ 276I/279F/283H/290Q/298 S/304R/341F/366E/368D, 8S/11M/23K/55K/57Y/69I/132V/141E/165R/173V/189L/ 219L/223I/236R/263G/276I/279F/283H/290Q/298S/304R/ 341F/366E/368D, 11M/23K/55S/57Y/69I/132V/141E/ 165R/173V/189L/219L/223I/236R/237H/263G/276I/279F/ 283H/290Q/298 S/304R/341F/366E/368D, 11M/23K/50M/ 55K/57Y/69I/132V/141E/165R/173V/189L/219L/223I/ 236R/263G/276I/279F/283H/290Q/298 S/304R/341F/ 366E/368D, 8S/11M/23K/50M/55K/57Y/69I/141E/165R/ 173V/189L/219L/223I/263G/276I/279F/283H/290Q/298S/ 304R/341F/366E/368D, 11M/23K/50M/55P/57Y/69I/ 132V/141E/165R/173V/189L/219L/223I/237G/263G/ 267E/276I/279F/283H/290 Q/298S/304R/341F/366E/ 368D, 8S/11M/23K/55K/57Y/69I/141E/165R/173V/189L/ 219L/223I/236R/237G/263G/276I/279F/283H/290Q/298S/ 304R/341F/366E/368D, 5T/8S/11M/23K/50M/55K/57Y/ 69I/132V/141E/165R/173V/189L/219L/223I/263G/276I/ 279F/283H/290Q/298 S/304R/341F/366E/368D, 8S/11M/ 23K/50M/55K/57Y/69I/141E/165R/173V/189L/219L/223I/ 237K/263G/276I/279F/283H/290Q/298S/304R/341F/366E/ 368D, 5T/11M/23K/50M/55K/57Y/69I/141E/165R/173V/ 189L/219L/223I/236R/237T/263G/267E/276I/279F/283H/ 290Q/298S/304R/341F/366E/368D, 11M/23K/50M/55K/ 57Y/69I/132V/141E/165R/173V/189L/219L/223I/237T/ 263G/267E/276I/279F/283H/290 Q/298S/304R/341F/ 366E/368D, 11M/23K/55K/57Y/69I/141E/165R/173V/ 189L/219L/223I/236R/263G/276I/279F/283H/290Q/298S/ 304R/341F/366E/368D, 11M/23K/55K/57Y/69I/141E/ 165R/173V/189L/219L/223I/236R/237R/263G/276I/279F/ 283H/290Q/298S/304R/341F/366E/368D, 8S/11M/23K/ 55K/57Y/69I/141E/165R/173V/189L/219L/223I/237R/ 263G/267E/276I/279F/283H/290Q/298S/304R/341F/366E/ 368D, 8S/11M/23K/55K/57Y/69I/141E/165R/173V/189L/ 219L/223I/263G/276I/279F/283H/290Q/298S/304R/341F/ 366E/368D, 11M/23K/55S/57Y/69I/141E/165R/173V/ 189L/219L/223I/236R/237T/263G/267E/276I/279F/283H/ 290Q/298 S/304R/341F/366E/368D, 5T/11M/23K/55K/ 57Y/69I/141E/165R/173V/189L/219L/223I/263G/276I/ 279F/283H/290Q/298S/304R/341F/366E/368D, 8S/11M/ 23K/50M/55P/57Y/69I/132V/141E/165R/173V/189L/ 219L/223I/237H/263G/276I/279F/283H/290Q/298S/304R/ 341F/366E/368D, 11M/23K/55K/57Y/69I/132V/141E/ 165R/173V/189L/219L/223I/263G/267E/276I/279F/283H/ 290Q/298S/304R/341F/366E/368D, 11M/23K/55K/57Y/ 69I/141E/165R/173V/189L/219L/223I/276I/279F/283H/ 290Q/298S/304R/341F/366E/368 D, 11M/23K/55K/57Y/ 69I/141E/165R/173V/189L/219L/263G/276I/279F/283H/ 290Q/298S/304R/341F/366E, 11M/23K/55K/57Y/69I/ 141E/165R/173V/219L/223I/263G/276I/279F/283H/290Q/ 298S/304R/341F/366E, 11M/23K/55K/57Y/69I/141E/ 165R/173V/189L/219L/223I/263G/276I/279F/290Q/298S/ 304R/341F/366E/368 D, 11M/55K/69I/165R/173V/189L/ 219L/263G/276I/279F/283H/290Q/298S/304R/341F/366E/ 368D, 11M/23K/55K/57Y/69I/141E/165R/173V/189L/ 223I/263G/276I/279F/283H/290Q/298S/304R/341F/366E/ 368 D, 11M/23K/55K/57Y/69I/141E/165R/173V/189L/ 263G/290Q/298S/304R/341F/366E, 11M/23K/55K/57Y/ 69I/141E/165R/189L/219L/223I/276I/279F/290Q/298S/ 304R/341F/366E, 23K/55/57Y/69I/141E/165R/173V/ 189L/219L/223I/263G/276I/279F/283H/290Q/298S/304R/ 341F/366E, 11M/23K/55K/69I/141E/165R/173V/189L/ 219L/223I/263G/276I/279F/283H/290Q/298S/304R/341F/ 366E/368 D, or 55K/57Y/69I/141E/165R/173V/189L/ 219L/223I/263G/283H/290Q/298S/304R/341F/366E, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 8/11/23/55/57/ 63/69/141/165/173/189/219/223/236/237/263/267/276/279/ 283/290/298/304/341/366/368, 8/11/23/55/57/69/82/141/ 165/173/189/219/223/236/237/263/267/276/279/283/290/ 298/304/341/366/368, 8/11/23/55/57/69/93/141/165/173/ 189/219/223/236/237/263/267/276/279/283/290/298/304/ 341/366/368, 8/9/11/23/55/57/69/141/165/173/189/219/ 223/236/237/263/267/276/279/283/290/298/304/341/366/ 368, 6/8/11/23/55/57/69/141/165/173/189/219/223/236/ 237/263/267/276/279/283/290/298/304/341/366/368, 8/11/ 23/55/57/69/141/165/173/189/219/223/236/237/254/263/ 267/276/279/283/290/298/304/341/366/368, 8/11/23/55/57/ 69/141/165/173/189/219/220/223/236/237/263/267/276/ 279/283/290/298/304/341/366/368, 8/11/23/55/57/69/141/ 165/173/189/219/223/236/237/263/267/276/279/283/290/ 298/304/341/366/368, 8/11/23/55/57/69/141/165/173/189/ 219/221/223/236/237/263/267/276/279/283/290/298/304/ 341/366/368, 8/11/23/55/57/69/141/155/165/173/189/219/ 223/236/237/263/267/276/279/283/290/298/304/341/366/ 368, 8/11/23/55/57/69/141/165/173/189/219/223/230/236/ 237/263/267/276/279/283/290/298/304/341/366/368, 8/11/ 23/55/57/69/141/165/173/189/219/223/236/237/263/267/ 276/279/283/290/298/304/308/341/366/368, 8/11/23/55/57/ 69/141/165/173/189/219/223/229/236/237/263/267/276/

279/283/290/298/304/341/366/368, 8/11/23/55/57/69/141/ 165/173/189/219/223/236/237/263/267/276/279/283/284/ 290/298/304/341/366/368, 8/11/23/55/57/69/141/165/173/ 189/199/219/223/236/237/263/267/276/279/283/290/298/ 304/341/366/368, 8/11/23/55/57/69/141/165/173/189/219/ 223/236/237/263/267/276/279/283/290/298/304/341/362/ 366/368, 8/11/23/55/57/69/141/165/173/189/219/223/236/ 237/263/267/276/279/283/290/298/304/308/341/366/368, 8/11/23/55/57/69/141/165/173/189/219/223/236/237/263/ 267/276/279/283/290/298/301/304/341/366/368, 8/11/23/ 55/57/69/141/165/173/189/219/223/236/237/263/267/276/ 279/283/290/298/300/304/341/366/368, 8/11/23/55/57/69/ 141/165/173/189/219/223/236/237/263/267/276/279/283/ 290/298/304/341/366/368, 8/11/23/55/57/69/141/165/173/ 189/219/223/236/237/263/267/276/279/283/290/298/304/ 341/366/368/395, 8/11/23/55/57/69/126/141/165/173/189/ 219/223/236/237/263/267/276/279/283/290/298/304/341/ 366/368, 8/11/23/55/57/69/141/165/173/189/219/223/236/ 237/263/267/276/279/283/290/298/304/341/366/368, 8/11/ 23/55/57/69/141/165/173/189/219/223/236/237/263/267/ 276/279/283/290/298/304/341/366/368/395, 8/11/23/55/57/ 69/141/165/173/189/219/223/236/237/263/267/276/279/ 283/290/298/304/341/366/368/384, 8/11/23/55/57/69/141/ 165/173/189/219/223/236/237/263/267/276/279/283/ 290/298/304/341/366/368, 8/11/23/55/57/69/141/165/173/ 189/219/223/236/237/263/267/276/279/283/290/298/304/ 323/341/366/368, 8/11/23/55/57/69/141/165/173/189/219/ 223/236/237/263/267/276/279/283/290/298/304/341/366/ 368/396, 8/11/23/55/57/69/141/165/173/189/219/223/236/ 237/263/267/276/279/283/290/298/304/341/366/368, 8/11/ 23/55/57/69/141/165/173/189/219/223/236/237/263/267/ 276/279/282/283/290/298/304/341/366/368, 8/11/23/55/57/ 69/141/165/173/175/189/219/223/236/237/263/267/276/ 279/283/290/298/304/341/366/368, 8/11/23/55/57/69/141/ 165/173/189/219/223/236/237/263/267/276/279/283/290/ 298/304/341/365/366/368, 8/11/23/55/57/69/141/165/173/ 189/219/223/236/237/263/267/276/279/283/290/298/304/ 341/366/368/396, 8/11/23/55/57/69/141/165/173/189/219/ 223/236/237/263/267/276/279/283/290/298/304/308/341/ 366/368, 8/11/23/55/57/69/141/165/173/189/219/223/236/ 237/263/267/276/279/283/290/298/304/341/366/368/398, 8/11/23/55/57/69/141/165/173/189/219/223/236/237/263/ 267/276/279/283/290/298/304/341/366/368, 8/11/23/55/57/ 69/141/165/173/189/219/223/236/237/253/263/267/276/ 279/283/290/298/304/341/366/368, 8/11/23/55/57/69/141/ 165/173/189/219/223/233/236/237/263/267/276/279/283/ 290/298/304/341/366/368, 8/11/23/55/57/69/141/165/173/ 189/219/223/236/237/263/267/276/279/283/290/298/304/ 341/366/368/384, 8/11/23/55/57/69/141/165/173/189/219/ 223/233/236/237/263/267/276/279/283/290/298/304/341/ 366/368, 8/11/23/55/57/69/141/165/173/189/219/223/236/ 237/263/267/276/279/283/290/298/304/341/366/368, 8/11/ 23/55/57/69/141/165/173/189/219/223/233/236/237/263/ 267/276/279/283/290/298/304/341/366/368, 8/11/23/55/57/ 69/141/165/173/189/219/223/236/237/263/267/276/279/ 283/290/298/301/304/341/366/368, 8/11/23/55/57/69/141/ 165/173/189/219/223/236/237/263/267/276/279/283/290/ 298/304/341/366/368, or 8/11/23/55/57/69/141/165/173/ 189/219/223/236/237/263/267/276/279/283/290/298/304/ 341/366/368/384, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 8S/11M/23K/55S/57Y/69I/141E/165R/173V/ 189L/219L/220I/223I/236R/237K/263G/267E/276I/279F/ 283H/290Q/298S/304R/341F/366E/368D, 8S/11M/23K/ 55S/57Y/69I/141E/165R/173V/189P/219L/223I/236R/ 237K/263G/267E/276I/279F/283H/290Q/298S/304R/341F/ 366E/368D, 8S/11M/23K/55S/57Y/69I/93L/141E/165R/ 173V/189L/219L/223I/236R/237K/263G/267E/276I/279F/ 283H/29 OQ/298S/304R/341F/366E/368D, 8S/11M/23K/ 55S/57Y/69I/141E/165R/173V/189S/219L/223/236R/ 237K/263G/267E/276I/279F/283H/290Q/298S/304R/341F/ 366E/368D, 8S/11M/23K/55S/57Y/69I/141E/165R/173V/ 189L/219L/221G/223I/236R/237K/263G/267E/276I/279F/ 283H/290Q/298S/304R/341F/366E/368D, 8S/11M/23K/ 55S/57Y/69I/141E/155F/165R/173V/189L/219L/223I/ 236R/237K/263G/267E/276I/279F/283H/290Q/298S/ 304R/341F/366E/368D, 8S/11M/23K/55S/57Y/69I/141E/ 165R/173V/189L/219L/223I/230V/236R/237K/263G/ 267E/276I/279F/283H/290Q/298S/304R/341F/366E/368D, 8S/11M/23K/55S/57Y/63G/69I/141E/165R/173V/189L/ 219L/223I/236R/237K/263G/267E/276I/279F/283H/29 OQ/298S/304R/341F/366E/368D, 8S/11M/23K/55S/57Y/ 69I/141E/165R/173V/189L/219L/223I/236R/237K/263G/ 267E/276I/279F/283H/284V/290Q/298S/304R/341F/366E/ 368D, 8S/11M/23K/55S/57Y/69I/141E/165R/173V/189L/ 219L/223I/236R/237K/263G/267E/276I/279F/283H/290Q/ 298S/304R/308K/341F/366E/368D, 8S/11M/23K/55S/57Y/ 69I/141E/165R/173V/189L/219L/223I/236R/237K/263G/ 267E/276I/279F/283H/284E/290Q/298S/304R/341F/366E/ 368D, 8S/11M/23K/55S/57Y/69I/141E/165R/173V/189L/ 219L/223I/229G/236R/237K/263G/267E/276I/279F/283H/ 290Q/298S/304R/341F/366E/368D, 8S/11M/23K/55S/57Y/ 69I/141E/165R/173V/189L/219L/223I/236R/237K/263G/ 267E/276I/279F/283H/284S/290Q/298S/304R/341F/366E/ 368D, 8S/11M/23K/55S/57Y/69I/141E/165R/173V/189L/ 199W/219L/223I/236R/237K/263G/267E/276I/279F/283H/ 290Q/298S/304R/341F/366E/368D, 8S/11M/23K/55S/57Y/ 69I/141E/165R/173V/189L/219L/223I/236R/237K/263G/ 267E/276I/279F/283H/290Q/298S/304R/341F/362E/366E/ 368D, 8S/11M/23K/55S/57Y/69I/141E/165R/173V/189L/ 219L/223I/236R/237K/263G/267E/276I/279F/283H/290Q/ 298S/304R/308S/341F/366E/368D, 8S/11M/23K/55S/57Y/ 69I/141E/165R/173V/189L/219L/223I/236R/237K/263G/ 267E/276I/279F/283H/290Q/298S/301G/304R/341F/366E/ 368D, 8S/11M/23K/55S/57Y/69I/141E/165R/173V/189L/ 219L/223I/236R/237K/263G/267E/276I/279F/283H/290Q/ 298S/300R/304R/341F/366E/368D, 8S/11M/23K/55S/57Y/ 69I/141E/165R/173V/189L/219L/223I/236R/237K/263G/ 267E/276I/279F/283H/290Q/298R/304R/341F/366E/368D, 8S/11M/23K/55S/57Y/69I/141E/165R/173V/189L/219L/ 223I/236R/237K/263G/267E/276I/279F/283H/290Q/298S/ 304R/341F/366E/368D/395R, 8S/11M/23K/55S/57Y/69I/ 126R/141E/165R/173V/189L/219L/223I/236R/237K/ 263G/267E/276I/279F/283H/290Q/298S/304R/341F/366E/ 368D, 8S/11M/23K/55S/57Y/69V/141E/165R/173V/189L/ 219L/223I/236R/237K/263G/267E/276I/279F/283H/290Q/ 298S/304R/341F/366E/368D, 8S/11M/23K/55S/57Y/69I/ 141E/165R/173V/189L/219L/223I/236R/237K/263G/ 267E/276I/279F/283H/290Q/298S/304R/341F/366E/368D/ 395A, 8S/11M/23K/55S/57Y/69I/141E/165R/173V/189L/ 219L/223I/233Q/236R/237K/263G/267E/276I/279F/283H/ 290Q/298S/304R/341F/366E/368D, 8S/11M/23K/55S/57Y/ 69I/141E/165R/173V/189L/219L/223I/236R/237K/263G/ 267E/276I/279F/283H/290Q/298S/304R/341F/366E/368D/ 384G, 8S/11M/23K/55S/57Y/69I/141E/165R/173V/189L/ 219L/223I/233V/236R/237K/263G/267E/276I/279F/283H/ 290Q/298S/304R/341F/366E/368D, 8S/11M/23K/55S/57Y/

69I/141E/165R/173V/189L/219L/223I/236R/237K/263G/
267E/276I/279F/283H/290Q/298S/304R/323S/341F/366E/
368D, 8S/11M/23K/55S/57Y/69I/141E/165R/173V/189L/
219L/223I/236R/237K/263G/267E/276I/279F/283H/290Q/
298S/304R/341F/366E/368D/396Q, 8S/11M/23K/55S/57Y/
69I/141E/165R/173V/189L/219L/223I/236R/237K/263G/
267E/276I/279F/283H/290Q/298G/304R/341F/366E/368D,
8S/11M/23K/55S/57Y/69I/141E/165R/173V/189L/219L/
223I/236R/237K/263G/267E/276I/279F/282Q/283H/290Q/
298S/304R/341F/366E/368D, 8S/11M/23K/55S/57Y/69I/
141E/165R/173V/189L/219L/223I/236R/237K/254A/
263G/267E/276I/279F/283H/290Q/298S/304R/341F/366E/
368D, 8S/11M/23K/55S/57Y/69I/141E/165R/173V/175V/
189L/219L/223I/236R/237K/263G/267E/276I/279F/283H/
290Q/298S/304R/341F/366E/368D, 8S/11M/23K/55S/57Y/
69I/141E/165R/173V/189L/219L/223I/236R/237K/263G/
267E/276I/279F/283H/290Q/298S/304R/341F/365R/366E/
368D, 8S/11M/23K/55S/57Y/69I/141E/165R/173V/189L/
219L/223I/236R/237K/263G/267E/276I/279F/283H/290Q/
298S/304R/341F/366E/368D/396R, 8S/11M/23K/55S/57Y/
69I/141E/165R/173V/189L/219L/223I/236R/237K/263G/
267E/276I/279F/283H/290Q/298S/304R/308L/341F/366E/
368D, 8S/11M/23K/55S/57Y/69I/141E/165R/173V/189L/
219L/223I/236R/237K/263G/267E/276I/279F/283H/290Q/
298S/304R/341F/366E/368D/398G, 8S/11M/23K/55S/57Y/
69I/141E/165R/173V/189L/219L/223I/236R/237K/263G/
267E/276I/279F/283H/290Q/298C/304R/341F/366E/368D,
8S/11M/23K/55S/57Y/69I/141V/165R/173V/189L/219L/
223I/236R/237K/263G/267E/276I/279F/283H/290Q/298S/
304R/341F/366E/368D, 8S/11M/23K/55S/57Y/69I/141E/
165R/173V/189L/219L/223I/236R/237K/253G/263G/
267E/276I/279F/283H/290Q/298S/304R/341F/366E/368D,
6P/8S/11M/23K/55S/57Y/69I/141E/165R/173V/189L/
219L/223I/236R/237K/263G/267E/276I/279F/283H/290
Q/298S/304R/341F/366E/368D, 8S/11M/23K/55S/57Y/
69I/141E/165R/173V/189L/219L/223I/233G/236R/237K/
263G/267E/276I/279F/283H/290Q/298S/304R/341F/366E/
368D, 8S/11M/23K/55S/57Y/69I/141E/165R/173V/189L/
219L/223I/236R/237K/263G/267E/276I/279F/283H/290Q/
298S/304R/341F/366E/368D/384Q, 8S/11M/23K/55S/57Y/
69I/82C/141E/165R/173V/189L/219L/223I/236R/237K/
263G/267E/276I/279F/283H/29 OQ/298S/304R/341F/
366E/368D, 8S/11M/23K/55S/57Y/69I/141E/165R/173V/
189L/219L/223I/233S/236R/237K/263G/267E/276I/279F/
283H/290Q/298S/304R/341F/366E/368D, 8S/11M/23K/
55S/57Y/69I/141E/165R/173V/189L/219L/223I/236R/
237K/263G/267E/276I/279F/283H/290Q/298S/304K/341F/
366E/368D, 8S/11M/23K/55S/57Y/69I/141E/165R/173V/
189L/219L/223I/233M/236R/237K/263G/267E/276I/279F/
283H/290Q/298S/304R/341F/366E/368D, 8S/9R/11M/
23K/55S/57Y/69I/141E/165R/173V/189L/219L/223I/
236R/237K/263G/267E/276I/279F/283H/290 Q/298S/
304R/341F/366E/368D, 8S/11M/23K/55S/57Y/69I/141E/
165R/173V/189L/219L/223I/236R/237K/263G/267E/276I/
279F/283H/290Q/298S/301S/304R/341F/366E/368D,
8S/11M/23K/55S/57Y/69I/141E/165R/173V/189L/219L/
223I/236R/237K/263G/267E/276I/279F/283H/290Q/298S/
304V/341F/366E/368D, 8S/11M/23K/55S/57Y/69I/141E/
165R/173V/189L/219L/223I/236R/237K/263G/267E/276I/
279F/283H/290Q/298N/304R/341F/366E/368D, or
8S/11M/23K/55S/57Y/69I/141E/165R/173V/189L/219L/
223I/236R/237K/263G/267E/276I/279F/283H/290Q/298S/
304R/341F/366E/368D/384A, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at positions 8/11/23/55/57/
69/141/165/173/189/219/223/233G/236/237/263/267/276/
279/283/290/298/304/341/366/368/395, 8/11/23/55/57/69/
141/165/173/189/219/223/233/236/237/263/267/276/279/
283/290/298/304/341/362/366/368, 8/11/23/55/57/69/141/
165/173/189/219/223/236/237/263/267/276/279/283/290/
298/304/341/362/366/368/384, 8/11/23/55/57/69/141/165/
173/189/219/223/236/237/263/267/276/279/283/290/298/
304/341/366/368/398, 8/11/23/55/57/69/141/165/173/189/
219/223/236/237/263/267/276/279/283/290/298R/304/341/
366/368, 8/11/23/55/57/69/141/165/173/189/219/223/230/
233/236/237/263/267/276/279/283/290/298/304/341/366/
368/384/395/398, 8/11/23/55/57/69/141/165/173/189/219/
223/230/236/237/263/267/276/279/283/290/298/304/341/
362/366/368/395, 8/11/23/55/57/69/141/165/173/189/219/
223/230/233/236/237/263/267/276/279/283/290/298/304/
308/341/366/368/384/395, 8/11/23/55/57/69/141/165/173/
189/219/223/230/233/236/237/263/267/276/279/283/290/
298/301/304/341/366/368/395, 8/11/23/55/57/69/141/165/
173/189/219/223/230/233/236/237/263/267/276/279/283/
290/298/304/341/366/368/384/395, 8/11/23/55/57/69/141/
165/173/189/219/223/233/236/237/263/267/276/279/283/
290/298/304/341/366/368/384/395, 8/11/23/55/57/69/141/
165/173/189/219/223/233/236/237/263/267/276/279/283/
290/298/304/341/362/366/368/395/398, 8/11/23/55/57/69/
141/165/173/189/219/223/230/236/237/263/267/276/279/
283/290/298/304/341/366/368, 8/11/23/55/57/69/141/165/
173/189/219/223/230/233/236/237/263/267/276/279/281/
283/290/298/304/341/366/368, 8/11/23/55/57/69/141/165/
173/189/219/223/230/233/236/237/263/267/276/279/283/
290/298/304/341/366/368/395/398, 8/11/23/55/57/69/141/
165/173/189/219/223/230/233/236/237/263/267/276/279/
283/290/298/304/341/362/366/368, 8/11/23/55/57/69/141/
165/173/189/219/223/230/233/236/237/263/267/276/279/
283/290/298/304/341/362/366/368/395, 8/11/23/55/57/69/
141/165/173/189/219/223/233/236/237/263/267/276/279/
283/290/298/304/308/341/366/368/384/395, 8/11/23/55/57/
69/141/165/173/189/219/223/233/236/237/263/267/276/
279/283/290/298/304/341/362/366/368/395, 8/11/23/55/57/
69/141/165/173/189/219/223/236/237/263/267/276/279/
283/290/298/301/304/341/366/368, 8/11/23/55/57/69/141/
165/173/189/219/223/233/236/237/263/267/276/279/283/
290/298/304/341/366/368, 8/11/23/55/57/69/141/165/173/
189/219/223/236/237/263/267/276/279/283/290/298/304/
341/366/368/384/398, 8/11/23/55/57/69/141/165/173/189/
219/223/236/237/263/267/276/279/283/290/298/304/341/
366/368/395/398, 8/11/23/55/57/69/141/165/173/189/219/
223/236/237/263/267/276/279/283/290/298/301S/304/308/
341/366/368/384, 8/11/23/55/57/69/141/165/173/189/219/
223/233/236/237/263/267/276/279/283/290/298R/304/341/
362/366/368, 8/11/23/55/57/69/141/165/173/189/219/223/
230/233/236/237/263/267/276/279/283/290/298/301/304/
341/362/366/368/384/395, 8/11/23/55/57/69/141/165/173/
189/219/223/236/237/263/267/276/279/283/290/298/304/
341/362/366/368/384, 8/11/23/55/57/69/141/165/173/189/
219/223/233/236/237/263/267/276/279/283/290/298/304/
341/366/368, 8/11/23/55/57/69/141/165/173/189/219/223/
233/236/237/263/267/276/279/283/290/298/301/304/341/
362/366/368, or 8/11/23/55/57/69/141/165/173/189/219/
223/230/233/236/237/263/267/276/279/283/290/298/301/
304/341/366/368/395, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 8% 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set, or amino acid residues: 8S/11M/23K/55S/57Y/69I/ 141E/165R/173V/189L/219L/223I/233S/236R/237K/263G/ 267E/276I/279F/283H/290Q/298S/304R/341F/362E/366E/ 368D, 8S/11M/23K/55S/57Y/69I/141E/165R/173V/189L/ 219L/223I/233M/236R/237K/263G/267E/276I/279F/283H/ 290Q/298N/304R/341F/362E/366E/368D, 8S/11M/23K/ 55S/57Y/69I/141E/165R/173V/189L/219L/223I/236R/ 237K/263G/267E/276I/279F/283H/290Q/298N/304R/ 341F/362E/366E/368D/384G, 8S/11M/23K/55S/57Y/69I/ 141E/165R/173V/189L/219L/223I/236R/237K/263G/ 267E/276I/279F/283H/290Q/298S/304R/341F/366E/368D/ 398G, 8S/11M/23K/55S/57Y/69I/141E/165R/173V/189L/ 219L/223I/236R/237K/263G/267E/276I/279F/283H/290Q/ 298R/304R/341F/366E/368D, 8S/11M/23K/55S/57Y/69I/ 141E/165R/173V/189L/219L/223I/230V/233Q/236R/ 237K/263G/267E/276I/279F/283H/290Q/298S/304R/341F/ 366E/368D/384G/395R/398G, 8S/11M/23K/55S/57Y/69I/ 141E/165R/173V/189L/219L/223I/230V/236R/237K/ 263G/267E/276I/279F/283H/290Q/298S/304R/341F/362E/ 366E/368D/395R, 8S/11M/23K/55S/57Y/69I/141E/165R/ 173V/189L/219L/223I/230V/233Q/236R/237K/263G/ 267E/276I/279F/283H/290Q/298S/304R/308K/341F/366E/ 368D/384G/395R, 8S/11M/23K/55S/57Y/69I/141E/165R/ 173V/189L/219L/223I/230V/233M/236R/237K/263G/ 267E/276I/279F/283H/290Q/298N/301S/304R/341F/366E/ 368D/395R, 8S/11M/23K/55S/57Y/69I/141E/165R/173V/ 189L/219L/223I/230V/233M/236R/237K/263G/267E/276I/ 279F/283H/290Q/298S/304R/341F/366E/368D/384G/ 395R, 8S/11M/23K/55S/57Y/69I/141E/165R/173V/189L/ 219L/223I/233Q/236R/237K/263G/267E/276I/279F/283H/ 290Q/298S/304R/341F/366E/368D/384G/395R, 8S/11M/ 23K/55S/57Y/69I/141E/165R/173V/189L/219L/223I/233S/ 236R/237K/263G/267E/276I/279F/283H/290Q/298S/ 304R/341F/366E/368D/384G/395R, 8S/11M/23K/55S/ 57Y/69I/141E/165R/173V/189L/219L/223I/233M/236R/ 237K/263G/267E/276I/279F/283H/290Q/298S/304R/341F/ 362E/366E/368D/395R/398G, 8S/11M/23K/55S/57Y/69I/ 141E/165R/173V/189L/219L/223I/230V/236R/237K/ 263G/267E/276I/279F/283H/290Q/298S/304R/341F/366E/ 368D, 8S/11M/23K/55S/57Y/69I/141E/165R/173V/189L/ 219L/223I/230V/233Q/236R/237K/263G/267E/276I/279F/ 281V/283H/290Q/298S/304R/341F/366E/368D, 8S/11M/ 23K/55S/57Y/69I/141E/165R/173V/189M/219L/223I/ 230V/233S/236R/237K/263G/267E/276I/279F/283H/ 290Q/298N/304R/341F/366E/368D/395R/398G, 8S/11M/ 23K/55S/57Y/69I/141E/165R/173V/189L/219L/223I/ 230V/233Q/236R/237K/263G/267E/276I/279F/283H/ 290Q/298N/304R/341F/362E/366E/368D, 8S/11M/23K/ 55S/57Y/69I/141E/165R/173V/189L/219L/223I/230V/ 233M/236R/237K/263G/267E/276I/279F/283H/290Q/ 298S/304R/341F/362E/366E/368D/395R, 8S/11M/23K/ 55S/57Y/69I/141E/165R/173V/189L/219L/223I/233M/ 236R/237K/263G/267E/276I/279F/283H/290Q/298N/ 304R/308K/341F/366E/368D/384G/395R, 8S/11M/23K/ 55S/57Y/69I/141E/165R/173V/189L/219L/223I/233S/ 236R/237K/263G/267E/276I/279F/283H/290Q/298S/ 304R/341F/362E/366E/368D/395R, 8S/11M/23K/55S/57Y/ 69I/141E/165R/173V/189L/219L/223I/236R/237K/263G/ 267E/276I/279F/283H/290Q/298Y/301S/304R/341F/366E/ 368D, 8S/11M/23K/55S/57Y/69I/141E/165R/173V/189L/ 219L/223I/233M/236R/237K/263G/267E/276I/279F/283H/ 290Q/298S/304R/341F/366E/368D, 8S/11M/23K/55S/57Y/ 69I/141E/165R/173V/189L/219L/223I/236R/237K/263G/ 267E/276I/279F/283H/290Q/298S/304R/341F/366E/368D/ 384G/398G, 8S/11M/23K/55S/57Y/69I/141E/165R/173V/ 189L/219L/223I/236R/237K/263G/267E/276I/279F/283H/ 290Q/298S/304R/341F/366E/368D/395R/398G, 8S/11M/ 23K/55S/57Y/69I/141E/165R/173V/189L/219L/223I/ 236R/237K/263G/267E/276I/279F/283H/290Q/298N/ 301S/304R/308K/341F/366E/368D/384G, 8S/11M/23K/ 55S/57Y/69I/141E/165R/173V/189L/219L/223I/233Q/ 236R/237K/263G/267E/276I/279F/283H/290Q/298R/ 304R/341F/362E/366E/368D, 8S/11M/23K/55S/57Y/69I/ 141E/165R/173V/189L/219L/223I/230V/233Q/236R/ 237K/263G/267E/276I/279F/283H/290Q/298R/301S/ 304R/341F/362E/366E/368D/384G/395R, 8S/11M/23K/ 55S/57Y/69I/141E/165R/173V/189L/219L/223I/230V/ 233S/236R/237K/263G/267E/276I/279F/283H/290Q/ 298N/301S/304R/341F/362E/366E/368D/384G/395R, 8S/11M/23K/55S/57Y/69I/141E/165R/173V/189L/219L/ 223I/236R/237K/263G/267E/276I/279F/283H/290Q/298S/ 304R/341F/362E/366E/368D/384G, 8S/11M/23K/55S/ 57Y/69I/141E/165R/173V/189L/219L/223I/233Q/236R/ 237K/263G/267E/276I/279F/283H/290Q/298S/304R/341F/ 366E/368D, 8S/11M/23K/55S/57Y/69I/141E/165R/173V/ 189L/219L/223I/233G/236R/237K/263G/267E/276I/279F/ 283H/290Q/298S/304R/341F/366E/368D/395R, 8S/11M/ 23K/55S/57Y/69I/141E/165R/173V/189L/219L/223I/ 233Q/236R/237K/263G/267E/276I/279F/283H/290Q/ 298N/301S/304R/341F/362E/366E/368D, 8S/11M/23K/ 55S/57Y/69I/141E/165R/173V/189L/219L/223I/230V/ 233Q/236R/237K/263G/267E/276I/279F/283H/290Q/ 298R/301S/304R/341F/366E/368D/395R, or 8S/11M/23K/ 55S/57Y/69I/141E/165R/173V/189L/219L/223I/230V/ 233Q/236R/237K/263G/267E/276I/279F/283H/290Q/ 298N/301S/304R/341F/366E/368D/395R, wherein the amino acid positions of the polypeptide sequence are relative to the reference sequence of SEQ ID NO: 2. In some embodiments, the amino acid positions are relative to SEQ ID NO: 94, 248, 352, 478, 832, 916, 1172, 1232, 1346, and/or 1488.

In some embodiments, the present invention further provides recombinant methionine gamma lyases and/or biologically active recombinant methionine gamma lyase fragments comprising polypeptide sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO: 94, 248, 352, 478, 832, 916, 1172, 1232, 1346, and/or 1488. In some embodiments, the recombinant methionine gamma lyase and/or biologically active recombinant methionine gamma lyase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 94, 248, 352, 478, 832, 916, 1172, 1232, 1346, and/or 1488. In some embodiments of the foregoing, the recombinant methionine gamma lyases and/or biologically active recombinant methionine gamma lyase fragments comprises polypeptide sequences having at least one substitution or substitution set at one or more positions: 2, 3, 4, 5, 6, 7, 8, 9, 11, 17, 21, 23, 25, 27, 29, 30, 31, 32, 33, 34, 35, 36, 38, 41, 43, 46, 47, 47, 48, 49, 50, 51, 53, 54, 55, 57, 58, 60, 62, 63, 66, 67, 68, 69, 82, 83, 87, 91, 99, 102, 111, 112, 113, 119, 124, 126, 127, 128, 132, 134, 138, 140, 141, 142, 144, 145, 146, 149, 150, 152, 154, 155, 156, 158, 160, 165, 167, 170, 173, 174, 175, 176, 177, 178, 179, 180, 181, 183, 189, 190, 193, 195, 199, 206, 209, 214, 219, 220, 221, 223, 225, 228, 229, 230, 231, 232, 233, 236, 237, 239, 240, 242, 243, 245, 247, 250, 251, 252, 253, 254, 255, 256, 259, 263, 267, 269, 270, 271, 272, 275, 276, 278, 279, 281, 282, 283, 284, 287, 288, 290, 295, 296, 298, 300, 301, 304, 308, 309, 312, 314, 315, 316, 317, 322, 323, 324, 325, 327, 333, 334, 335, 336, 338, 341, 344, 348, 353, 357, 358, 361, 362, 364, 365, 366, 367, 368, 383, 384, 386, 388, 390, 391, 392, 394, 395, 396, 398, or combinations thereof, wherein the amino acid positions are relative to the reference sequence of SEQ ID NO: 94, 248, 352, 478, 832, 916, 1172, 1232, 1346, and/or 1488. In some embodiments, the recombinant methionine gamma lyases and/or biologically active recombinant methionine gamma lyase fragments comprises polypeptide sequences having the following amino acid residues: 2K/S/T/W, 3A/E/P/S, 4E/G/R/V, 5G/H/I/K/P/T, 6L/P/R/S, 7E/F/G/L/S/V, 8G/P/R/S/Y, 9A/R, 11S/A/C/G/H/M/R, 17C, 21A, 23S/K, 25E, 27S, 29T, 30N, 31A, 32N, 33A/T, 34L, 35G/S, 36S, 38F, 41E, 43A, 46Q, 47G, 47Q, 48M/R, 49A/T, 50L/M/V, 51K/N/S, 53L, 54I/Q/R, 55E/H/K/P/A/N, 57Y/H, 58T, 60T, 62A/C/H, 63G, 66Q/S, 67A/Q/R/V, 68D/G, 69R/V/I/W, 82C, 83S, 87G, 91S/L, 99A, 102A, 111H, 112A, 113M/T, 119T, 124A/H/R/S/V, 126A/E/R/S, 127A/K/Q/V, 128H, 132V, 134F, 138C/S/T, 140T, 141Q/V/E/G/P/R/S/T, 142L/S, 144R, 145G/S, 146S, 149D/T, 150T, 152A, 154V, 155F, 156L, 158S, 160M, 165R, 167T, 170G/P/Q/W, 173V/A, 174E, 175V, 176V, 177T, 178A, 179A/S/W, 180G/V, 181I, 183V, 189I/M/P/S/Y/L, 190A/G/L, 193S, 195S/T, 199T, 199W, 206I, 209G, 214C, 219L/V/I, 220I/V, 221G, 223L/I, 225C, 228A/R, 229G/H/S, 230V, 231V, 232P, 233G/M/Q/S/V, 236A/C/R/Y, 237A/G/H/K/L/R/T/V/Y, 239C/K/T/V/Y, 240D/G/P/R, 242F, 243C/G/S, 245G/S, 247M, 250F/S, 251A/N, 252C, 253G/M, 254A, 255V, 256L/V, 259L, 263G/K/P/Q/S/A, 267N/E/R/T, 269S, 270S, 271D, 272S, 275A/H/N/R/S, 276V/I/L, 278C, 279H/F/W, 281V, 282A/N/Q/V, 283N/Q/H, 284A/E/S/V, 287D/V, 288A/G/I/K/M/Q/R/S/T/W, 290N/Q/V/A/K, 295G/S/E, 296G/N, 298G/K/P/S/V/C/G/N/R/Y, 300R, 301D/E/G/K/N/Q/S, 304R/K/V, 308A/K/L/S, 309A/K, 312A, 314L, 315S, 316L, 317R, 322A/E/K/Q/V, 323K/S/T, 324S, 325A, 327M, 333F/S/T, 334V/L, 335I, 336H, 338G, 341F, 344C/T/V/A/G/R/S, 348V, 353T, 357A/G, 358C/K/L/R/T, 361V, 362R/E, 364L, 365K/R, 366Q/R/E, 367A, 368G/D, 383I, 384A/G/Q/S, 386I, 388R, 390L, 391N/E, 392H, 394P, 395A/D/H/R, 396Q/R/V, 398G/P/Q, or combination thereof, wherein the amino acid positions are relative to the reference sequence of SEQ ID NO: 94, 248, 352, 478, 832, 916, 1172, 1232, 1346, and/or 1488.

In some embodiments, the recombinant methionine gamma lyase comprises a polypeptide sequence having at least 80%, 85%, 86%, 87%, 88%, 89%, 90%, 91%, 92%, 93%, 94%, 95% 96%, 97%, 98%, 99%, or more sequence identity to SEQ ID NO: 94, or a functional fragment thereof, and wherein the polypeptide sequence comprises at least one substitution or substitution set at one or more positions 38, 38/55, 38/55/150/189/290/322/361/366, 38/55/189, 38/55/189/275, 38/55/189/275/290/361, 38/55/189/278/361/366, 38/55/189/290/361/366, 38/55/189/304/322, 38/55/189/322, 38/55/189/322/366, 38/55/189/361, 38/55/275/278/290/361/366, 38/55/290/304/322/361/366, 38/55/304, 38/55/322/366, 38/149/189/275/322, 38/150/189/322/361/366, 38/189, 38/189/275/322/366, 38/189/290/322, 38/189/304/322, 38/189/304/366, 38/275, 38/278, 38/290, 38/290/322/361, 38/304, 38/322, 38/361, 38/366, 55, 55/189/322/361/366, 55/275, 55/275/366, 55/290/322, 55/304/366, 150/189/290, 189, 189/322, 278/366, and 388, wherein the amino acid positions of the polypeptide sequence are relative to the reference sequence of SEQ ID NO: 94. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set 38F, 38F/55E, 38F/55E/189L, 38F/55E/189L/275N/290N/361V, 38F/55E/189L/278C/361V/366E, 38F/55E/189L/322A, 38F/55E/304R, 38F/55H/189L/290N/361V/366E, 38F/55H/189L/361V, 38F/55H/290N/304R/322K/361V/366E, 38F/55K, 38F/55K/189L/275N, 38F/55K/189L/322A/366E, 38F/55K/322K/366E, 38F/55P/150T/189L/290N/322A/361V/366E, 38F/55P/189L/304R/322K, 38F/55P/189L/322A/366E, 38F/55P/275N/278C/290N/361V/366E, 38F/149T/189L/275N/322K, 38F/150T/189L/322K/361V/366E, 38F/189L, 38F/189L/275N/322K/366E, 38F/189L/290N/322K, 38F/189L/304R/322A, 38F/189L/304R/366E, 38F/275N, 38F/278C, 38F/290N, 38F/290N/322A/361V, 38F/304R, 38F/322A, 38F/361V, 38F/366E, 55H, 55H/275N, 55K, 55K/189L/322K/361V/366E, 55K/275N, 55K/275N/366E, 55K/290N/322A, 55K/304R/366E, 150T/189L/290N, 189L, 189L/322K, 278C/366E, or 388R, wherein the amino acid positions of the polypeptide sequence are relative to the reference sequence of SEQ ID NO: 94. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set Y38F, Y38F/G55E, Y38F/G55E/Y189L, Y38F/G55E/Y189L/Q275N/A290N/P361V, Y38F/G55E/Y189L/E278C/P361V/H366E, Y38F/G55E/Y189L/I322A, Y38F/G55E/Q304R, Y38F/G55H/Y189L/A290N/P361V/H366E, Y38F/G55H/Y189L/P361V, Y38F/G55H/A290N/Q304R/I322K/P361V/H366E, Y38F/G55K, Y38F/G55K/Y189L/Q275N, Y38F/G55K/Y189L/I322A/H366E, Y38F/G55K/I322K/H366E, Y38F/G55P/K150T/Y189L/A290N/I322A/P361V/H366E, Y38F/G55P/Y189L/Q304R/I322K, Y38F/G55P/Y189L/I322A/H366E, Y38F/G55P/Q275N/E278C/A290N/P361V/H366E, Y38F/P149T/Y189L/Q275N/I322K, Y38F/K150T/Y189L/I322K/P361V/H366E, Y38F/Y189L, Y38F/Y189L/Q275N/I322K/H366E, Y38F/Y189L/A290N/I322K, Y38F/Y189L/Q304R/I322A, Y38F/Y189L/Q304R/H366E, Y38F/Q275N, Y38F/E278C, Y38F/A290N, Y38F/A290N/I322A/P361V, Y38F/Q304R, Y38F/I322A, Y38F/P361V, Y38F/H366E, G55H, G55H/Q275N, G55K, G55K/Y189L/I322K/P361V/H366E, G55K/Q275N, G55K/Q275N/H366E, G55K/A290N/I322A, G55K/Q304R/H366E, K150T/Y189L/A290N, Y189L, Y189L/I322K, E278C/H366E, or A388R, wherein the amino acid positions of the polypeptide sequence are relative to the reference sequence of SEQ ID NO: 94.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set at one or more positions 11, 29, 29/34/68/220/253/279/283/358, 29/34/279, 29/47/68/102/132/220/250/358, 29/47/279/283/358, 29/220, 34, 34/43/47/283, 34/68/132/253/283, 34/132/279/358, 38, 38/54/165/173/283/336, 38/54/173/283/322/336, 38/54/

189/283, 38/54/283/336, 38/54/336, 38/165/173/189, 38/165/283, 38/173, 38/173/189/290, 38/173/189/290/322, 38/173/283/336, 38/173/322, 38/283, 38/322, 43/102, 47/126/237/279, 50, 54/165/173/290/322, 54/165/189/290/ 336, 54/173/283, 54/189/322, 58, 68, 68/283, 68/358, 87, 112, 126, 165/173/189/283, 165/189, 165/189/283/290/336, 173/189/283/336, 189, 220, 236, 240, 279, 290, 317, 334, 357, 358, 364, and 367, wherein the amino acid positions of the polypeptide sequence are relative to the reference sequence of SEQ ID NO: 248. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set 11A, 11C, 11G, 11H, 11M, 11R, 29T, 29T/34L/68D/ 220V/253M/279W/283H/358T, 29T/34L/279W, 29T/47G/ 68D/102A/132V/220V/250F/358T, 29T/47G/279W/283H/ 358T, 29T/220V, 34L, 34L/43A/47G/283H, 34L/68D/132V/ 253M/283H, 34L/132V/279W/358T, 38F, 38F/54Q/165R/ 173V/283H/336H, 38F/54Q/173V/283H/322A/336H, 38F/ 54Q/189L/283H, 38F/54Q/283H/336H, 38F/54Q/336H, 38F/165R/173V/189L, 38F/165R/283H, 38F/173V, 38F/ 173V/189L/290N, 38F/173V/189L/290N/322A, 38F/173V/ 283H/336H, 38F/173V/322A, 38F/283H, 38F/322A, 43A/ 102A, 47G/126A/237V/279W, 50L, 50M, 50V, 54Q/165R/ 173V/290N/322A, 54Q/165R/189L/290N/336H, 54Q/ 173V/283H, 54Q/189L/322A, 58T, 68D/283H, 68D/358T, 68G, 87G, 112A, 126E, 126R, 126S, 165R/173V/189L/ 283H, 165R/189L, 165R/189L/283H/290N/336H, 173V/ 189L/283H/336H, 189L, 220V, 236A, 236C, 240D, 240G, 240P, 240R, 279F, 290N, 290Q, 290V, 317R, 334V, 357A, 357G, 358L, 358T, 364L, or 367A, wherein the amino acid positions of the polypeptide sequence are relative to the reference sequence of SEQ ID NO: 248. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set S11A, S11C, S11G, S11H, S11M, S11R, V29T, V29T/Q34L/A68D/T220V/S253M/H279W/Q283H/ S358T, V29T/Q34L/H279W, V29T/A47G/A68D/R102A/ I132V/T220V/H250F/S358T, V29T/A47G/H279W/ Q283H/S358T, V29T/T220V, Q34L, Q34L/V43A/A47G/ Q283H, Q34L/A68D/I132V/S253M/Q283H, Q34L/I132V/ H279W/S358T, Y38F, Y38F/E54Q/Q165R/A173V/Q283H/ S336H, Y38F/E54Q/A173V/Q283H/I322A/S336H, Y38F/ E54Q/Y189L/Q283H, Y38F/E54Q/Q283H/S336H, Y38F/ E54Q/S336H, Y38F/Q165R/A173V/Y189L, Y38F/Q165R/ Q283H, Y38F/A173V, Y38F/A173V/Y189L/A290N, Y38F/ A173V/Y189L/A290N/I322A, Y38F/A173V/Q283H/ S336H, Y38F/A173V/I322A, Y38F/Q283H, Y38F/I322A, V43A/R102A, A47G/G126A/E237V/H279W, F50L, F50M, F50V, E54Q/Q165R/A173V/A290N/I322A, E54Q/Q165R/ Y189L/A290N/S336H, E54Q/A173V/Q283H, E54Q/ Y189L/I322A, F58T, A68D/Q283H, A68D/S358T, A68G, A87G, T112A, G126E, G126R, G126S, Q165R/A173V/ Y189L/Q283H, Q165R/Y189L, Q165R/Y189L/Q283H/ A290N/S336H, A173V/Y189L/Q283H/S336H, Y189L, T220V, L236A, L236C, K240D, K240G, K240P, K240R, H279F, A290N, A290Q, A290V, E317R, L334V, S357A, S357G, S358L, S358T, R364L, or H367A, wherein the amino acid positions of the polypeptide sequence are relative to the reference sequence of SEQ ID NO: 248.

In some embodiments, the recombinant methionine gamma lyase comprises a polypeptide sequence having at least 80%, 85%, 86%, 87%, 88%, 89%, 90%, 91%, 92%, 93% 94%, 95%, 96%, 97%, 98%, 99%, or more sequence identity to SEQ ID NO: 352, or a functional fragment thereof, and wherein the polypeptide sequence comprises at least one substitution or substitution set at one or more positions 11, 11/38, 11/38/50/54/126/189/322, 11/38/50/54/ 126/189/336/390/391, 11/38/50/54/126/240/290, 11/38/50/ 54/126/240/367, 11/38/50/54/250/290, 11/38/50/68, 11/38/ 50/126/189/240/250/290, 11/38/50/240, 11/38/50/290/367, 11/38/54, 11/38/54/68/126/290/336/367, 11/38/54/189/240/ 290, 11/38/54/189/290, 11/38/54/250/336, 11/38/68/189/ 240/290/367, 11/38/126/189/322/367, 11/38/126/322/336, 11/38/189, 11/38/189/240, 11/38/189/290/367, 11/38/189/ 322, 11/38/250/336, 11/38/290, 11/38/290/322, 11/38/290/ 322/336/367, 11/38/336, 11/50/68/126/290, 11/50/68/189/ 240, 11/50/68/290, 11/50/126, 11/50/240/250/290, 11/50/ 367, 11/54, 11/54/126, 11/54/189, 11/189/290/322, 11/240/ 250/290, 11/240/290, 11/290, 11/290/336, 11/322, 11/336, 11/394, 38/50/54/189/367, 38/54/236, 38/126/189/367, 38/126/240, 38/126/240/290, 50/54/68, 50/54/126/240/250/ 290, 50/54/240/322, 50/240, 68, 240, 322, and 336, wherein the amino acid positions of the polypeptide sequence are relative to the reference sequence of SEQ ID NO: 352. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set 11A/38F/50M/54Q/126A/ 189Y/322A, 11A/38F/50M/240R, 11A/38F/50M/290Q/ 367A, 11A/38F/54Q/68D/126A/290V/336H/367A, 11A/ 38F/54Q/189Y/240R/290V, 11A/38F/54Q/250F/336H, 11A/38F/126A/322A/336H, 11A/38F/189Y, 11A/38F/ 189Y/290V/367A, 11A/50M/68D/189Y/240R, 11A/50M/ 126A, 11A/50M/367A, 11A/54Q, 11A/54Q/189Y, 11A/ 189Y/290Q/322A, 11A/240R/290Q, 11C/38F/50M/54Q/ 126A/240R/290V, 11C/38F/50V/54Q/126A/240R/367A, 11C/38F/290Q, 11M, 11M/38F, 11M/38F/50M/54Q/126A/ 189Y/336H/390L/391E, 11M/38F/50M/54Q/250S/290Q, 11M/38F/50M/68D, 11M/38F/50M/126A/189Y/240R/ 250F/290Q, 11M/38F/50M/240R, 11M/38F/54Q, 11M/38F/ 54Q/189Y/290V, 11M/38F/68D/189Y/240R/290Q/367A, 11M/38F/126A/189Y/322A/367A, 11M/38F/189Y/240R, 11M/38F/189Y/322A, 11M/38F/250F/336H, 11M/38F/ 290Q/322A, 11M/38F/290Q/322A/336H/367A, 11M/38F/ 336H, 11M/50M/68D/126A/290Q, 11M/50M/68D/290Q, 11M/50V/240R/250S/290Q, 11M/54Q/126A, 11M/240R/ 250S/290Q, 11M/290V, 11M/290V/336H, 11M/322A, 11M/ 336H, 11M/394P, 38F/50V/54Q/189Y/367A, 38F/54Q/ 236A, 38F/126A/189Y/367A, 38F/126A/240R, 38F/126A/ 240R/290V, 50M/54Q/68D, 50M/54Q/126A/240R/250F/ 290Q, 50M/54Q/240R/322A, 50V/240R, 68D, 240R, 322A, or 336H, wherein the amino acid positions of the polypeptide sequence are relative to the reference sequence of SEQ ID NO: 352. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set S11A/ Y38F/F50M/E54Q/G126A/L189Y/I322A, S11A/Y38F/ F50M/K240R, S11A/Y38F/F50M/A290Q/H367A, S11A/ Y38F/E54Q/A68D/G126A/A290V/S336H/H367A, S11A/

Y38F/E54Q/L189Y/K240R/A290V, S11A/Y38F/E54Q/ H250F/S336H, S11A/Y38F/G126A/I322A/S336H, S11A/ Y38F/L189Y, S11A/Y38F/L189Y/A290V/H367A, S11A/ F50M/A68D/L189Y/K240R, S11A/F50M/G126A, S11A/ F50M/H367A, S11A/E54Q, S11A/E54Q/L189Y, S11A/ L189Y/A290Q/I322A, S11A/K240R/A290Q, S11C/Y38F/ F50M/E54Q/G126A/K240R/A290V, S11C/Y38F/F50V/ E54Q/G126A/K240R/H367A, S11C/Y38F/A290Q, S11M, S11M/Y38F, S11M/Y38F/F50M/E54Q/G126A/L189Y/ S336H/I390L/D391E, S11M/Y38F/F50M/E54Q/H250S/ A290Q, S11M/Y38F/F50M/A68D, S11M/Y38F/F50M/ G126A/L189Y/K240R/H250F/A290Q, S11M/Y38F/F50M/ K240R, S11M/Y38F/E54Q, S11M/Y38F/E54Q/L189Y/ A290V, S11M/Y38F/A68D/L189Y/K240R/A290Q/H367A, S11M/Y38F/G126A/L189Y/I322A/H367A, S11M/Y38F/ L189Y/K240R, S11M/Y38F/L189Y/I322A, S11M/Y38F/ H250F/S336H, S11M/Y38F/A290Q/I322A, S11M/Y38F/ A290Q/I322A/S336H/H367A, S11M/Y38F/S336H, S11M/ F50M/A68D/G126A/A290Q, S11M/F50M/A68D/A290Q, S11M/F50V/K240R/H250S/A290Q, S11M/E54Q/G126A, S11M/K240R/H250S/A290Q, S11M/A290V, S11M/ A290V/S336H, S11M/I322A, S11M/S336H, S11M/L394P, Y38F/F50V/E54Q/L189Y/H367A, Y38F/E54Q/L236A, Y38F/G126A/L189Y/H367A, Y38F/G126A/K240R, Y38F/ G126A/K240R/A290V, F50M/E54Q/A68D, F50M/E54Q/ G126A/K240R/H250F/A290Q, F50M/E54Q/K240R/ I322A, F50V/K240R, A68D, K240R, I322A, or S336, wherein the amino acid positions of the polypeptide sequence are relative to the reference sequence of SEQ ID NO: 352.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set at one or more positions 2/55/290/334/368, 2/271/290/322/368, 3/283/368, 3/368, 4/368, 5/368, 7/368, 8/368, 9/368, 21/368, 27/368, 30/368, 31/368, 32/368, 33/368, 35/368, 36/368, 46/368, 48/368, 49/368, 53/54/55/290/334/368, 53/54/55/290/368, 53/54/240/334/368, 53/54/275/279/334/336/368, 53/54/ 275/279/368, 53/54/290/368, 53/54/368, 53/240/334, 53/368, 54/55/236/279/290/334/368/392, 54/55/290/368, 54/179/368, 54/236/368, 54/240/388, 54/290/368, 55/236/ 290/368, 55/240/368, 60/368, 62/368, 66/368, 67/368, 69/368, 83/368, 91/368, 99/368, 111/195/368, 113/368, 119/ 368, 124/353/368, 124/368, 128/368, 146/368, 154/368, 156/368, 158/368, 160/368, 167/368, 173/368, 176/368, 179/279/368, 181/368, 183/368, 190/368, 195/368, 206/368, 209/368, 214/368, 219/368, 221/368, 225/368, 231/368, 236/279/368, 236/368, 239/368, 240/322, 240/334/392, 240/ 367, 240/368/388/392, 242/368, 243/368, 245/368, 247/368, 251/368, 256/298/368, 256/368, 259/368, 263/368, 269/368, 272/368, 279/368, 290/322/334/368, 290/322/334/368/392, 290/334/336/368, 290/334/368, 290/334/368/392, 290/368, 309/368, 312/368, 314/368, 315/368, 325/368, 333/334/368, 334/368, 334/368/388, 335/368, 338/368, 344/368, 368, 368/386, 368/388, 368/390, 368/391, and 368/392, wherein the amino acid positions of the polypeptide sequence are relative to the reference sequence of SEQ ID NO: 478. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set 2S/55E/290Q/334V/368D, 2S/271D/290Q/322K/368D, 3A/283N/368D, 3P/368D, 3S/368D, 4G/368D, 4R/368D, 5G/368D, 5H/368D, 5I/368D, 5K/368D, 5P/368D, 7E/368D, 7F/368D, 7G/368D, 7L/368D, 7V/368D, 8P/368D, 8R/368D, 8S/368D, 8Y/368D, 9A/368D, 21A/368D, 27S/368D, 30N/368D, 31A/368D, 32N/368D, 33A/368D, 33T/368D, 35G/368D, 35S/368D, 36S/368D, 46Q/368D, 48M/368D, 48R/368D, 49A/368D, 49T/368D, 53L/54Q/55H/290Q/334V/368D, 53L/54Q/55H/290V/368D, 53L/54Q/240R/334V/368D, 53L/54Q/275H/290V/368D, 53L/54Q/275N/279F/334V/ 336H/368D, 53L/54Q/290V/368D, 53L/54Q/368D, 53L/ 240R/334V, 53L/368D, 54Q/55H/236Y/279F/290Q/334V/ 368D/392H, 54Q/55H/290Q/368D, 54Q/179A/368D, 54Q/ 236Y/368D, 54Q/240R/388R, 54Q/290V/368D, 55H/236Y/ 290Q/368D, 55H/240R/368D, 60T/368D, 62A/368D, 62C/ 368D, 62H/368D, 66Q/368D, 66S/368D, 67A/368D, 67Q/ 368D, 67R/368D, 67V/368D, 69R/368D, 83S/368D, 91S/ 368D, 99A/368D, 111H/195S/368D, 113M/368D, 113T/ 368D, 119T/368D, 124A/368D, 124H/368D, 124R/353T/ 368D, 124S/368D, 124V/368D, 128H/368D, 146S/368D, 154V/368D, 156L/368D, 158S/368D, 160M/368D, 167T/ 368D, 173A/368D, 176V/368D, 179F/279F/368D, 181I/ 368D, 183V/368D, 190G/368D, 190L/368D, 195T/368D, 206I/368D, 209G/368D, 214C/368D, 219L/368D, 219V/ 368D, 221G/368D, 225C/368D, 231V/368D, 236Y/279F/ 368D, 236Y/368D, 239C/368D, 239T/368D, 239V/368D, 239Y/368D, 240R/322K, 240R/334V/392H, 240R/367A, 240R/368D/388R/392H, 242F/368D, 243C/368D, 243G/ 368D, 243S/368D, 245G/368D, 245S/368D, 247M/368D, 251A/368D, 256L/298V/368D, 256V/368D, 259L/368D, 263G/368D, 263K/368D, 263Q/368D, 263S/368D, 269S/ 368D, 272S/368D, 279F/368D, 290Q/322K/334V/368D, 290Q/322K/334V/368D/392H, 290Q/334V/368D, 290Q/ 334V/368D/392H, 290Q/368D, 290V/334V/336H/368D, 309A/368D, 312A/368D, 314L/368D, 315S/368D, 325A/ 368D, 333S/334V/368D, 334V/368D, 334V/368D/388R, 335I/368D, 338G/368D, 344A/368D, 344G/368D, 344R/ 368D, 344S/368D, 368D, 368D/386I, 368D/388R, 368D/ 390L, 368D/391N, or 368D/392H, wherein the amino acid positions of the polypeptide sequence are relative to the reference sequence of SEQ ID NO: 478. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set R2S/K55E/A290Q/L334V/G368D, R2S/ A271D/A290Q/I322K/G368D, D3A/H283N/G368D, D3P/ G368D, D3S/G368D, S4G/G368D, S4R/G368D, N5G/ G368D, N5H/G368D, N5I/G368D, N5K/G368D, N5P/ G368D, N7E/G368D, N7F/G368D, N7G/G368D, N7L/ G368D, N7V/G368D, T8P/G368D, T8R/G368D, T8S/ G368D, T8Y/G368D, G9A/G368D, P21A/G368D, A27S/ G368D, P30N/G368D, P31A/G368D, V32N/G368D, Y33A/G368D, Y33T/G368D, T35G/G368D, T35S/G368D, A36S/G368D, G46Q/G368D, A48M/G368D, A48R/ G368D, C49A/G368D, C49T/G368D, E53L/E54Q/K55H/ A290Q/L334V/G368D, E53L/E54Q/K55H/A290V/G368D, E53L/E54Q/K240R/L334V/G368D, E53L/E54Q/Q275H/ A290V/G368D, E53L/E54Q/Q275N/H279F/L334V/ S336H/G368D, E53L/E54Q/A290V/G368D, E53L/E54Q/ G368D, E53L/K240R/L334V, E53L/G368D, E54Q/K55H/ L236Y/H279F/A290Q/L334V/G368D/Q392H, E54Q/ K55H/A290Q/G368D, E54Q/H179A/G368D, E54Q/ L236Y/G368D, E54Q/K240R/A388R, E54Q/A290V/

G368D, K55H/L236Y/A290Q/G368D, K55H/K240R/ G368D, S60T/G368D, I62A/G368D, I62C/G368D, I62H/ G368D, T66Q/G368D, T66S/G368D, L67A/G368D, L67Q/ G368D, L67R/G368D, L67V/G368D, I69R/G368D, G83S/ G368D, G91S/G368D, T99A/G368D, R111H/Q195S/ G368D, L113M/G368D, L113T/G368D, A119T/G368D, G124A/G368D, G124H/G368D, G124R/S353T/G368D, G124S/G368D, G124V/G368D, F128H/G368D, A146S/ G368D, I154V/G368D, F156L/G368D, T158S/G368D, A160M/G368D, V167T/G368D, V173A/G368D, T176V/ G368D, H179A/H279F/G368D, L181I/G368D, I183V/ G368D, C190G/G368D, C190L/G368D, Q195T/G368D, V206I/G368D, A209G/G368D, S214C/G368D, I219L/ G368D, I219V/G368D, A221G/G368D, V225C/G368D, I231V/G368D, L236Y/H279F/G368D, L236Y/G368D, L239C/G368D, L239T/G368D, L239V/G368D, L239Y/ G368D, K240R/I322K, K240R/L334V/Q392H, K240R/ H367A, K240R/G368D/A388R/Q392H, M242F/G368D, T243C/G368D, T243G/G368D, T243S/G368D, A245G/ G368D, A245S/G368D, L247M/G368D, D251A/G368D, M256L/A298V/G368D, M256V/G368D, I259L/G368D, A263G/G368D, A263K/G368D, A263Q/G368D, A263S/ G368D, H269S/G368D, N272S/G368D, H279F/G368D, A290Q/I322K/L334V/G368D, A290Q/I322K/L334V/ G368D/Q392H, A290Q/L334V/G368D, A290Q/L334V/ G368D/Q392H, A290Q/G368D, A290V/L334V/S336H/ G368D, L309A/G368D, G312A/G368D, I314L/G368D, A315S/G368D, G325A/G368D, Q333S/L334V/G368D, L334V/G368D, L334V/G368D/A388R, F335I/G368D, A338G/G368D, T344A/G368D, T344G/G368D, T344R/ G368D, T344S/G368D, G368D, G368D/L386I, G368D/ A388R, G368D/I390L, G368D/D391N, or G368D/Q392H, wherein the amino acid positions of the polypeptide sequence are relative to the reference sequence of SEQ ID NO: 478.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set at one or more positions 3/8, 8/83/219/240/334/368, 8/219/272, 83, 119/ 315/334/368, 127/279/322, 173, 190, 206, 219, 219/263/ 334, 219/334/368, 263, 263/334, 272, 272/334/368, 279, 279/368, 315/334, 322, 322/368, 334, 334/368, and 368, wherein the amino acid positions of the polypeptide sequence are relative to the reference sequence of SEQ ID NO: 832. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set 3P/8S, 8S, 8S/83S/ 219V/240R/334L/368G, 8S/219V/272S, 83S, 119T/315S/ 334L/368G, 127Q/279F/322K, 173A, 190G, 206I, 219V, 219V/263G/334L, 219V/334L/368G, 263G, 263G/334L, 272S, 272S/334L/368G, 279F, 279F/368G, 315S/334L, 322K, 322K/368G, 334L, 334L/368G, or 368G, wherein the amino acid positions of the polypeptide sequence are relative to the reference sequence of SEQ ID NO: 832. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set D3P/T8S, T8S, T8S/G83S/I219V/K240R/ V334L/D368G, T8S/I219V/N272S, G83S, A119T/A315S/ V334L/D368G, E127Q/H279F/I322K, V173A, C190G, V206I, I219V, I219V/A263G/V334L, I219V/V334L/ D368G, A263G, A263G/V334L, N272S, N272S/V334L/ D368G, H279F, H279F/D368G, A315S/V334L, I322K, I322K/D368G, V334L, V334L/D368G, or D368G, wherein the amino acid positions of the polypeptide sequence are relative to the reference sequence of SEQ ID NO: 832.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set at one or more positions 3/57/173, 3/141/395, 5, 5/7, 5/7/54/57/344, 5/7/ 149, 5/41/272/279, 5/127/149/240/344/395, 5/141/178/240, 5/240, 5/240/272/298/344, 6, 7/41/149/344, 7/54/127/228/ 240/298/344, 7/57/141/279/298/395, 7/127/240, 7/178/240, 7/240, 7/240/272/395, 7/272, 23, 51, 54/57/344, 54/127/282, 54/272, 57, 57/127/344, 57/141/344, 57/240, 57/272, 57/298, 127, 127/149/240/298, 127/149/272/279/282/298/ 344, 127/240, 127/279/282/344, 127/344, 141, 141/149/344, 141/263/272/344, 141/279, 144, 149, 149/240/272, 149/272/ 282/298/344, 149/272/344/395, 149/282, 149/298, 149/344, 189, 190, 219, 223, 228, 229, 233/240/263/272/395, 239, 240, 240/263, 240/344, 252, 255, 256, 263, 270, 276, 279/282, 282, 284, 288, 298, 301, 315, 316, 323, 324, 335, 341, 344, 344/395, 362, 365, 384, 395, 396, and 398, wherein the amino acid positions of the polypeptide sequence are relative to the reference sequence of SEQ ID NO: 916. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set 3P/57Y/173A, 3P/141E/395D, 5H, 5H/7E, 5H/7E/54R/57Y/344A, 5H/7E/ 149D, 5H/41E/272S/279F, 5H/127K/149D/240R/344A/ 395D, 5H/141E/178A/240R, 5H/240R, 5H/240R/272S/ 298P/344A, 6L, 6R, 6S, 7E/41E/149D/344A, 7E/54R/127K/ 228A/240R/298P/344A, 7E/57Y/141E/279F/298P/395D, 7E/127K/240R, 7E/178A/240R, 7E/240R, 7E/240R/272S/ 395D, 7E/272S, 23K, 51K, 51N, 51S, 54R/57Y/344A, 54R/ 127K/282A, 54R/272S, 57Y, 57Y/127K/344A, 57Y/141E/ 344A, 57Y/240R, 57Y/272S, 57Y/298P, 127A, 127K, 127K/149D/240R/298P, 127K/149D/272S/279F/282A/ 298P/344A, 127K/240R, 127K/279F/282A/344A, 127K/ 344A, 127V, 141E, 141E/149D/344A, 141E/263A/272S/ 344A, 141E/279F, 141G, 141P, 141R, 141S, 141T, 144R, 149D, 149D/240R/272S, 149D/272S/282A/298P/344A, 149D/272S/344A/395D, 149D/282A, 149D/298P, 149D/ 344A, 149T, 189I, 190A, 219L, 223I, 228R, 229H, 229S, 233Q/240R/263A/272S/395D, 239K, 240R, 240R/263A, 240R/344A, 252C, 255V, 256L, 263A, 270S, 276I, 276L, 279F/282A, 282A, 282N, 282V, 284A, 284S, 288A, 288G, 288I, 288M, 288Q, 288R, 288S, 288T, 288W, 298G, 298K, 298P, 298S, 301D, 301E, 301K, 301Q, 315S, 316L, 323K, 323T, 324S, 335I, 341F, 344A, 344A/395D, 362R, 365K, 384S, 395D, 395R, 396R, 396V, 398G, or 398Q, wherein the amino acid positions of the polypeptide sequence are relative to the reference sequence of SEQ ID NO: 916. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set D3P/H57Y/V173A, D3P/Q141E/K395D, N5H, N5H/N7E, N5H/N7E/E54R/H57Y/T344A, N5H/ N7E/P149D, N5H/P41E/N272S/H279F, N5H/E127K/ P149D/K240R/T344A/K395D, N5H/Q141E/G178A/ K240R, N5H/K240R, N5H/K240R/N272S/A298P/T344A, N6L, N6R, N6S, N7E/P41E/P149D/T344A, N7E/E54R/ E127K/K228A/K240R/A298P/T344A, N7E/H57Y/Q141E/ H279F/A298P/K395D, N7E/E127K/K240R, N7E/G178A/ K240R, N7E/K240R, N7E/K240R/N272S/K395D, N7E/ N272S, S23K, A51K, A51N, A51S, E54R/H57Y/T344A, E54R/E127K/R282A, E54R/N272S, H57Y, H57Y/E127K/ T344A, H57Y/Q141E/T344A, H57Y/K240R, H57Y/ N272S, H57Y/A298P, E127A, E127K, E127K/P149D/ K240R/A298P, E127K/P149D/N272S/H279F/R282A/ A298P/T344A, E127K/K240R, E127K/H279F/R282A/ T344A, E127K/T344A, E127V, Q141E, Q141E/P149D/ T344A, Q141E/G263A/N272S/T344A, Q141E/H279F, Q141G, Q141P, Q141R, Q141S, Q141T, K144R, P149D, P149D/K240R/N272S, P149D/N272S/R282A/A298P/ T344A, P149D/N272S/T344A/K395D, P149D/R282A, P149D/A298P, P149D/T344A, P149T, L189I, C190A, V219L, L223I, K228R, A229H, A229S, R233Q/K240R/ G263A/N272S/K395D, L239K, K240R, K240R/G263A, K240R/T344A, A252C, L255V, M256L, G263A, C270S, V276I, V276L, H279F/R282A, R282A, R282N, R282V, P284A, P284S, L288A, L288G, L288I, L288M, L288Q, L288R, L288S, L288T, L288W, A298G, A298K, A298P, A298S, A301D, A301E, A301K, A301Q, A315S, F316L, E323K, E323T, A324S, F335I, L341F, T344A, T344A/ K395D, Q362R, A365K, D384S, K395D, K395R, A396R, A396V, A398G, or A398Q, wherein the amino acid positions of the polypeptide sequence are relative to the reference sequence of SEQ ID NO: 916.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set at one or more positions 23/219/223/276/288/298/301/365, 23/219/239/ 341, 23/219/240/276/279, 23/219/240/276/279/298, 23/219/ 240/276/298/324, 23/219/276/298, 23/219/276/341, 23/219/ 298/341, 23/239/240/255/276/279/298/324, 23/239/255/ 276/279/335/341, 23/240/255/276/324/335, 23/240/255/ 279, 23/240/276/298, 23/255/276/298, 23/263/276/279/282/ 298/341, 23/276/282/335, 23/276/298/324, 23/276/298/324/ 335, 23/279/282/335/396, 23/279/335, 23/341, 219/223/ 240/279, 219/223/276/298/341/396, 219/223/276/335, 219/ 240, 219/240/276/335, 219/276/279/282, 219/276/279/298/ 301, 219/276/298/324/335, 219/276/335, 219/279/341, 223/ 229/279/335, 223/255, 223/335/365, 229/255/276/282/341, 239/240/255/276/298/316/335, 239/240/276/316, 239/240/ 276/341, 239/279/298/335/341, 239/279/341, 240, 240/276/ 279, 240/279, 240/298, 255/298/341, 263/270/276, 276/279/ 298/316, 276/279/324/335/341, 276/298/324/335, 276/335/ 341, 276/341, 279/341, 298/301, 298/341, 335, and 341, wherein the amino acid positions of the polypeptide sequence are relative to the reference sequence of SEQ ID NO: 1172. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set 23K/219L/223I/ 276I/288I/298K/301Q/365K, 23K/219L/239K/341F, 23K/ 219L/240R/276I/279F, 23K/219L/240R/276I/279F/298K, 23K/219L/240R/276I/298K/324S, 23K/219L/276I/298K, 23K/219L/276I/341F, 23K/219L/298K/341F, 23K/239K/ 240R/255V/276I/279F/298P/324S, 23K/239K/255V/276I/ 279F/335I/341F, 23K/240R/255V/276I/324S/335I, 23K/ 240R/255V/279F, 23K/240R/276I/298K, 23K/255V/276I/ 298K, 23K/263A/276I/279F/282A/298K/341F, 23K/276I/ 282A/335I, 23K/276I/298K/324S, 23K/276I/298K/324S/ 335I, 23K/279F/282A/335I/396V, 23K/279F/335I, 23K/ 341F, 219L/223I/240R/279F, 219L/223I/276I/298P/341F/ 396V, 219L/223I/276I/335I, 219L/240R, 219L/240R/276I/ 335I, 219L/276I/279F/282A, 219L/276I/279F/298K/301Q, 219L/276I/298K/324S/335I, 219L/276I/335I, 219L/279F/ 341F, 223I/229S/279F/335I, 223I/255V, 223I/335I/365K, 229S/255V/276I/282A/341F, 239K/240R/255V/276I/298P/ 316L/335I, 239K/240R/276I/316L, 239K/240R/276I/341F, 239K/279F/298K/335I/341F, 239K/279F/341F, 240R, 240R/276I/279F, 240R/279F, 240R/298K, 255V/298K/ 341F, 263A/270S/276I, 276I/279F/298P/316L, 276I/279F/ 324S/335I/341F, 276I/298K/324S/335I, 276I/335I/341F, 276I/341F, 279F/341F, 298P/301Q, 298P/341F, 335I, or 341F, wherein the amino acid positions of the polypeptide sequence are relative to the reference sequence of SEQ ID NO: 1172. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set S23K/V219L/ L223I/V276I/L288I/A298K/A301Q/A365K, S23K/V219L/ L239K/L341F, S23K/V219L/K240R/V276I/H279F, S23K/ V219L/K240R/V276I/H279F/A298K, S23K/V219L/ K240R/V276I/A298K/A324S, S23K/V219L/V276I/ A298K, S23K/V219L/V276I/L341F, S23K/V219L/A298K/ L341F, S23K/L239K/K240R/L255V/V276I/H279F/A298P/ A324S, S23K/L239K/L255V/V276I/H279F/F335I/L341F, S23K/K240R/L255V/V276I/A324S/F335I, S23K/K240R/ L255V/H279F, S23K/K240R/V276I/A298K, S23K/L255V/ V276I/A298K, S23K/G263A/V276I/H279F/R282A/ A298K/L341F, S23K/V276I/R282A/F335I, S23K/V276I/ A298K/A324S, S23K/V276I/A298K/A324S/F335I, S23K/ H279F/R282A/F335I/A396V, S23K/H279F/F335I, S23K/ L341F, V219L/L223I/K240R/H279F, V219L/L223I/V276I/ A298P/L341F/A396V, V219L/L223I/V276I/F335I, V219L/ K240R, V219L/K240R/V276I/F335I, V219L/V276I/ H279F/R282A, V219L/V276I/H279F/A298K/A301Q, V219L/V276I/A298K/A324S/F335I, V219L/V276I/F335I, V219L/H279F/L341F, L223I/A229S/H279F/F335I, L223I/ L255V, L223I/F335I/A365K, A229S/L255V/V276I/ R282A/L341F, L239K/K240R/L255V/V276I/A298P/ F316L/F335I, L239K/K240R/V276I/F316L, L239K/ K240R/V276I/L341F, L239K/H279F/A298K/F335I/L341F, L239K/H279F/L341F, K240R, K240R/V276I/H279F, K240R/H279F, K240R/A298K, L255V/A298K/L341F, G263A/C270S/V276I, V276I/H279F/A298P/F316L, V276I/H279F/A324S/F335I/L341F, V276I/A298K/A324S/ F335I, V276I/F335I/L341F, V276I/L341F, H279F/L341F, A298P/A301Q, A298P/L341F, F335I, or L341F, wherein the amino acid positions of the polypeptide sequence are relative to the reference sequence of SEQ ID NO: 1172.

In some embodiments, the recombinant methionine gamma lyase comprises a polypeptide sequence having at least 80%, 85%, 86%, 87%, 8% 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set at one or more positions 2, 3, 4, 5, 7, 8, 17, 47, 50, 55, 132, 134, 145, 170, 174, 179, 223, 223/239, 223/239/240, 223/239/240/279/335, 223/239/255/ 316, 223/239/298/316, 223/239/316/335, 223/240/298, 223/ 255, 223/255/298, 223/255/298/316, 223/255/335, 223/279/ 298, 223/279/298/335, 223/279/335, 223/288, 223/288/298, 223/298, 223/316, 223/335, 236, 237, 239, 239/279/298/ 316, 239/288, 240/255, 240/279, 240/288/335, 255, 255/ 279, 255/298, 255/335, 267, 275, 279, 279/298/335, 287, 288, 290/295, 295, 298, 298/335, 309, 316, 322, 333, 358, and 383, wherein the amino acid positions of the polypeptide sequence are relative to the reference sequence of SEQ ID NO: 1232. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set 2K, 2W, 3E, 3S, 4E, 4V, 5T, 7L, 7S, 8G, 8P, 8S, 17C, 47Q, 50M, 55E, 55N, 55P, 55S, 132V, 134F, 145G, 145S, 170G, 170Q, 174E, 179W, 223I, 223I/239K, 223I/239K/240R, 223I/239K/240R/279F/ 335I, 223I/239K/255V/316L, 223I/239K/298K/316L, 223I/ 239K/316L/335I, 223I/240R/298S, 223I/255V, 223I/255V/ 298K, 223I/255V/298K/316L, 223I/255V/335I, 223I/279F/ 298S, 223I/279F/298S/335I, 223I/279F/335I, 223I/288I, 223I/288I/298K, 223I/298S, 223I/316L, 223I/335I, 236R, 237A, 237G, 237H, 237K, 237L, 237R, 237V, 237Y, 239K, 239K/279F/298K/316L, 239K/288I, 240R/255V, 240R/ 279F, 240R/288I/335I, 255V, 255V/279F, 255V/298P, 255V/335I, 267N, 267R, 275R, 275S, 279F, 279F/298K/ 335I, 287D, 288I, 290K/295S, 295E, 298K, 298K/335I, 309A, 309K, 316L, 322V, 333T, 358C, 358K, 358R, or 383I, wherein the amino acid positions of the polypeptide sequence are relative to the reference sequence of SEQ ID NO: 1232. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set R2K, R2W, D3E, D3S, S4E, S4V, N5T, N7L, N7S, T8G, T8P, T8S, H17C, A47Q, F50M, K55E, K55N, K55P, K55S, I132V, H134F, A145G, A145S, A170G, A170Q, D174E, H179W, L223I, L223I/L239K, L223I/L239K/K240R, L223I/L239K/ K240R/H279F/F335I, L223I/L239K/L255V/F316L, L223I/ L239K/A298K/F316L, L223I/L239K/F316L/F335I, L223I/ K240R/A298S, L223I/L255V, L223I/L255V/A298K, L223I/L255V/A298K/F316L, L223I/L255V/F335I, L223I/ H279F/A298S, L223I/H279F/A298S/F335I, L223I/H279F/ F335I, L223I/L288I, L223I/L288I/A298K, L223I/A298S, L223I/F316L, L223I/F335I, L236R, E237A, E237G, E237H, E237K, E237L, E237R, E237V, E237Y, L239K, L239K/H279F/A298K/F316L, L239K/L288I, K240R/ L255V, K240R/H279F, K240R/L288I/F335I, L255V, L255V/H279F, L255V/A298P, L255V/F335I, D267N, D267R, Q275R, Q275S, H279F, H279F/A298K/F335I, E287D, L288I, Q290K/P295S, P295E, A298K, A298K/ F335I, L309A, L309K, F316L, I322V, Q333T, S358C, S358K, S358R, or V383I, wherein the amino acid positions of the polypeptide sequence are relative to the reference sequence of SEQ ID NO: 1232.

In some embodiments, the recombinant methionine gamma lyase comprises a polypeptide sequence having at least 80%, 85%, 86%, 87%, 8% 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set at one or more positions 5, 5/8/50/132, 5/8/55/132/236/237, 5/8/236/237/267, 5/50, 5/50/236/237/267, 5/55/132, 5/236/237, 8, 8/50, 8/50/55/ 132/237, 8/50/237, 8/55, 8/55/236/237/267, 8/55/267, 8/132/236, 8/236/237, 8/237, 8/237/267, 11/23/276/279/ 368, 11/368, 23/57/141/223, 50, 50/55/132/237/267, 50/132/ 180/237, 50/132/236, 50/132/237/267, 50/236/237, 55/132, 55/132/236/237, 55/132/237, 55/236/237, 55/236/237/267, 55/267, 57, 132, 132/236/237, 132/267, 173/263/283/368, 189/368, 219, 219/223/276/279/283/368, 223/368, 236, 236/ 237, 236/237/267, 237, 237/267, 263, and 283, wherein the amino acid positions of the polypeptide sequence are relative to the reference sequence of SEQ ID NO: 1346. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set 5T, 5T/8S/50M/132V, 5T/8S/55A/132V/ 236R/237T, 5T/8S/236R/237H/267E, 5T/50M, 5T/50M/ 236R/237T/267E, 5T/55S/132V, 5T/236R/237H, 8S, 8S/50M, 8S/50M/55P/132V/237H, 8S/50M/237K, 8S/55A/ 267E, 8S/55S, 8S/55S/236R/237K/267E, 8S/132V/236R, 8S/236R/237G, 8S/236R/237K, 8S/237H, 8S/237R, 8S/237R/267E, 11S/23S/276V/279H/368G, 11S/368G, 23S/ 57H/141Q/223L, 50M, 50M/55P/132V/237G/267E, 50M/ 132V/180V/237H, 50M/132V/236R, 50M/132V/237T/ 267E, 50M/236R/237R, 55A/236R/237K, 55P/132V/237H, 55P/267E, 55S/132V, 55S/132V/236R/237H, 55S/236R/ 237T/267E, 57H, 132V, 132V/236R/237A, 132V/267E, 173A/263A/283Q/368G, 189Y/368G, 219I, 219I/223L/ 276V/279H/283Q/368G, 223L/368G, 236R, 236R/237H/ 267E, 236R/237R, 237H, 237H/267E, 263A, or 283Q, wherein the amino acid positions of the polypeptide sequence are relative to the reference sequence of SEQ ID NO: 1346. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set N5T, N5T/T8S/ F50M/I132V, N5T/T8S/K55A/I132V/L236R/E237T, N5T/ T8S/L236R/E237H/D267E, N5T/F50M, N5T/F50M/ L236R/E237T/D267E, N5T/K55S/I132V, N5T/L236R/ E237H, T8S, T8S/F50M, T8S/F50M/K55P/I132V/E237H, T8S/F50M/E237K, T8S/K55A/D267E, T8S/K55S, T8S/ K55S/L236R/E237K/D267E, T8S/I132V/L236R, T8S/ L236R/E237G, T8S/L236R/E237K, T8S/E237H, T8S/ E237R, T8S/E237R/D267E, M11S/K23S/I276V/F279H/ D368G, M11S/D368G, K23S/Y57H/E141Q/I223L, F50M, F50M/K55P/I132V/E237G/D267E, F50M/I132V/D180V/ E237H, F50M/I132V/L236R, F50M/I132V/E237T/D267E, F50M/L236R/E237R, K55A/L236R/E237K, K55P/I132V/ E237H, K55P/D267E, K55S/I132V, K55S/I132V/L236R/ E237H, K55S/L236R/E237T/D267E, Y57H, I132V, I132V/ L236R/E237A, I132V/D267E, V173A/G263A/H283Q/ D368G, L189Y/D368G, L219I, L219I/I223L/I276V/ F279H/H283Q/D368G, I223L/D368G, L236R, L236R/ E237H/D267E, L236R/E237R, E237H, E237H/D267E, G263A, or H283Q, wherein the amino acid positions of the polypeptide sequence are relative to the reference sequence of SEQ ID NO: 1346.

In some embodiments, the recombinant methionine gamma lyase comprises a polypeptide sequence having at least 80%, 85%, 86%, 87%, 88%89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set at one or more positions 6, 9, 63, 69, 82, 93, 126, 141, 155, 175, 189, 199, 220, 221, 229, 230, 233, 253, 254, 282, 284, 298, 300, 301, 304, 308, 323, 362, 365, 384, 395, 396, and 398, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set 6P, 9R, 63G, 69V, 82C, 93L, 126R, 141V, 155F, 175V, 189P, 189S, 199W, 220I, 221G, 229G, 230V, 233G, 233M, 233Q, 233S, 233V, 253G, 254A, 282Q, 284E, 284S, 284V, 298C, 298G, 298N, 298R, 300R, 301G, 301S, 304K, 304V, 308K, 308L, 308S, 323S, 362E, 365R, 384A, 384G, 384Q, 395A, 395R, 396Q, 396R, or 398G, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set N6P, G9R, S63G, 169V, A82C, 193L, G126R, E141V, Y155F, A175V, L189P, L189S, E199W, T220I, A221G, A229G, L230V, R233G, R233M, R233Q, R233S, R233V, S253G, L254A, R282Q, P284E, P284S, P284V, S298C, S298G, S298N, S298R, Y300R, A301G, A301S, R304K, R304V, R308K, R308L, R308S, E323S, Q362E, A365R, D384A, D384G, D384Q, K395A, K395R, A396Q, A396R, or A398G, wherein the amino acid positions of the polypeptide sequence are relative to the reference sequence of SEQ ID NO: 1488.

In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set at one or more positions 189/230/233/298/395/398, 230, 230/233/281, 230/233/298/301/362/384/395, 230/233/298/301/395, 230/233/298/362, 230/233/308/384/395, 230/233/362/395, 230/233/384/395, 230/233/384/395/398, 230/362/395, 233, 233/298/301/362, 233/298/308/384/395, 233/298/362, 233/362, 233/362/395, 233/362/395/398, 233/384/395, 233/395, 298, 298/301, 298/301/308/384, 298/362/384, 362/384, 384/398, 395/398, and 398, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set 189M/230V/233S/298N/395R/398G, 230V, 230V/233M/298N/301S/395R, 230V/233M/362E/395R, 230V/233M/384G/395R, 230V/233Q/281V, 230V/233Q/298N/301S/395R, 230V/233Q/298N/362E, 230V/233Q/298R/301S/362E/384G/395R, 230V/233Q/298R/301S/395R, 230V/233Q/384G/395R, 230V/233Q/308K/384G/395R, 230V/233Q/384G/395R/398G, 230V/233S/298N/301S/362E/384G/395R, 230V/362E/395R, 233G/395R, 233M, 233M/298N/308K/384G/395R, 233M/298N/362E, 233M/362E/395R/398G, 233Q, 233Q/298N/301S/362E, 233Q/298R/362E, 233Q/384G/395R, 233S/362E, 233S/362E/395R, 233S/384G/395R, 298N/301S/308K/384G, 298N/362E/384G, 298R, 298Y/301S, 362E/384G, 384G/398G, 395R/398G, or 398G, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88% 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set L189M/L230V/R233S/S298N/K395R/A398G, L230V, L230V/R233M/S298N/A301S/K395R, L230V/R233M/Q362E/K395R, L230V/R233M/D384G/K395R, L230V/R233Q/A281V, L230V/R233Q/S298N/A301S/K395R, L230V/R233Q/S298N/Q362E, L230V/R233Q/S298R/A301S/Q362E/D384G/K395R, L230V/R233Q/S298R/A301S/K395R, L230V/R233Q/R308K/D384G/K395R, L230V/R233Q/D384G/K395R/A398G, L230V/R233S/S298N/A301S/Q362E/D384G/K395R, L230V/Q362E/K395R, R233G/K395R, R233M, R233M/S298N/R308K/D384G/K395R, R233M/S298N/Q362E, R233M/Q362E/K395R/A398G, R233Q, R233Q/S298N/A301S/Q362E, R233Q/S298R/Q362E, R233Q/D384G/K395R, R233S/Q362E, R233S/Q362E/K395R, R233S/D384G/K395R, S298N/A301S/R308K/D384G, S298N/Q362E/D384G, S298R, S298Y/A301S, Q362E/D384G, D384G/A398G, K395R/A398G, or A398G, wherein the amino acid positions of the polypeptide sequence are relative to the reference sequence of SEQ ID NO: 1488.

In some embodiments, the recombinant methionine gamma lyase polypeptide sequence has at least about 80%, about 85%, about 86%, about 87%, about 88%, about 89%, about 90%, about 91%, about 92%, about 93%, about 94%, about 95%, about 96%, about 97%, about 98%, about 99% or more sequence identity to an even-numbered sequence of SEQ ID NOS: 2-1734. In some embodiments, the recombinant methionine gamma lyase polypeptide sequence has at least 80%, 85%, 86%, 87%, 88%, 89%, 90%, 91%, 92%, 93%, 94%, 95%, 96%, 97%, 98%, 99% or more sequence identity to an even-numbered sequence of SEQ ID NOS: 2-1734.

In some embodiments, the recombinant methionine gamma lyase polypeptide comprises a polypeptide sequence of an even-numbered sequence of SEQ ID NOS: 2-1734. In some embodiments, the recombinant methionine gamma lyase polypeptide comprises a polypeptide sequence of an even-numbered sequence of SEQ ID NOS: 2-1734, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide includes 1, 2, 3, 4, up to 5 substitutions in the polypeptide sequence. In some embodiments, the recombinant methionine gamma lyase polypeptide includes 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions. In some embodiments, guidance on non-conservative and conservative substitutions are provided by the variants disclosed herein. In some embodiments, the recombinant methionine gamma lyase polypeptide comprises a polypeptide sequence of an even-numbered sequence of SEQ ID NOS: 4-206. In some embodiments, the recombinant methionine gamma lyase polypeptide comprises a polypeptide sequence of an even-numbered sequence of SEQ ID NOS: 4-206, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 208-298. In some embodiments, the recombinant methionine gamma lyase polypeptide comprises a polypeptide sequence of an even-numbered sequence of SEQ ID NOS: 208-298, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 300-444. In some embodiments, the recombinant methionine gamma lyase polypeptide comprises a polypeptide sequence of an even-numbered sequence of SEQ ID NOS: 300-444, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 446-562. In some embodiments, the recombinant methionine gamma lyase polypeptide comprises a polypeptide sequence of an even-numbered sequence of SEQ ID NOS: 446-562, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 564-878. In some embodiments, the recombinant methionine gamma lyase polypeptide comprises a polypeptide sequence of an even-numbered sequence of SEQ ID NOS: 564-878, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 880-928. In some embodiments, the recombinant methionine gamma lyase polypeptide comprises a polypeptide sequence of an even-numbered sequence of SEQ ID NOS: 880-928, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 930-1174. In some embodiments, the recombinant methionine gamma lyase polypeptide comprises a polypeptide sequence of an even-numbered sequence of SEQ ID NOS: 930-1174, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 1176-1286. In some embodiments, the recombinant methionine gamma lyase polypeptide comprises a polypeptide sequence of an even-numbered sequence of SEQ ID NOS: 1176-1286, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 1288-1460. In some embodiments, the recombinant methionine gamma lyase polypeptide comprises a polypeptide sequence of an even-numbered sequence of SEQ ID NOS: 1288-1460, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 1462-1564. In some embodiments, the recombinant methionine gamma lyase polypeptide comprises a polypeptide sequence of an even-numbered sequence of SEQ ID NOS: 1462-1564, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 1566-1666. In some embodiments, the recombinant methionine gamma lyase polypeptide comprises a polypeptide sequence of an even-numbered sequence of SEQ ID NOS: 1566-1666, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide comprises a polypeptide sequence of an even-numbered sequence of SEQ ID NOS: 1668-1734. In some embodiments, the recombinant methionine gamma lyase polypeptide comprises a polypeptide sequence of an even-numbered sequence of SEQ ID NOS: 1668-1734, wherein the polypeptide sequence has optionally 1, 2, 3, 4, 5, 6, 7, 8, 9, or up to 10 substitutions in the polypeptide sequence. In some embodiments, the recombinant methionine gamma lyase polypeptide includes 1, 2, 3, 4, up to 5 substitutions in the polypeptide sequence. In some embodiments, the recombinant methionine gamma lyase polypeptide includes 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions.

In some embodiments, the recombinant methionine gamma lyase comprises the polypeptide sequence of SEQ ID NO: 94, 248, 352, 478, 832, 916, 1172, 1232, 1346, 1488 or 1706. In some embodiments, the recombinant methionine gamma lyase has optionally 1, 2, 3, 4, 5, 6, 7, 8, 9, or up to 10 substitutions in the foregoing polypeptide sequence. In some embodiments, the recombinant methionine gamma lyase polypeptide includes 1, 2, 3, 4, up to 5 substitutions in the polypeptide sequence. In some embodiments, the recombinant methionine gamma lyase polypeptide includes 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions.

In some additional embodiments, it is known in the art that protein synthesis is initiated with N-terminal methionine in eukaryotes or formylmethionine in prokaryotes and mitochondria. In eukaryotes, the initiating methionine is removed by cleavage of an N-terminal signal peptide present in secreted proteins or by the action of a methionine amino peptidase. In prokaryotes, the formylmethionine can be removed by formylmethionine deformylase and the resulting methionine removed by a methionine amino peptidase. Accordingly, it is to be understood that for each and every embodiment of a recombinant methionine gamma lyase polypeptide described herein that contains an N-terminal initiating methionine or formylmethionine, the present disclosure also provides recombinant methionine gamma lyase polypeptides lacking the initiating methionine or formylmethionine. By way of example and not limitation, when the present disclosure provides a recombinant methionine gamma lyase polypeptide as an amino acid sequence in reference to a specified sequence, where amino acid position 1 is an initiating methionine or formylmethionine, in some embodiments, the present disclosure also provides a recombinant methionine gamma lyase polypeptide beginning at residue 2 in reference to the specified sequence, which lacks the initiating methionine or formylmethionine. Accordingly, when the present disclosure provides a recombinant methionine gamma lyase polypeptide comprising a sequence corresponding to a SEQ ID NO., in some embodiments, the present disclosure also provides a recombinant methionine gamma lyase polypeptide comprising an amino acid sequence corresponding to the SEQ ID NO. lacking the N-terminal initiating methionine or formylmethionine at amino acid position 1.

In some embodiments, the engineered methionine gamma lyase polypeptide comprises a functional or biologically active fragment of an engineered methionine gamma lyase polypeptide encompassed by the invention. Functional fragments have at least 80%, 81%, 82%, 83%, 84%, 85%, 86%, 87%, 88%, 89%, 90%, 91%, 92%, 93%, 94%, 95%, 96%, 97%, 98%, or 99% of the activity of the engineered methionine gamma lyase polypeptide from which is was derived (i.e., the parent engineered methionine gamma lyase).

In some embodiments, a functional fragment comprises at least 80%, 81%, 82%, 83%, 84%, 85%, 86%, 87%, 88%, 89%, 90%, 91%, 92%, 93%, 94%, 95%, 96%, 97%, 98% and even 99% of the parent sequence of the engineered methionine gamma lyase. In some embodiments the functional fragment is truncated by less than 5, less than 10, less than 15, less than 10, less than 25, less than 30, less than 35, less than 40, less than 45, and less than 50 amino acids.

In some embodiments, the recombinant methionine gamma lyase described herein have one or more improved properties as compared to a reference methionine gamma lyase polypeptide. In some embodiments, the recombinant methionine gamma lyase is more thermostable than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pHs less than 7, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pH 7, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pHs less than 5, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pH 5, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more stable at pH 5.2, than the methionine gamma lyase polypeptide of reference sequence of SEQ ID NO: 2, 94, 248, 352, 478, 832, 916, 1172, 1232, 1346, and/or 1488. In some embodiments, the reference methionine gamma lyase polypeptide is the reference sequence of SEQ ID NO: 2.

In some embodiments, the recombinant methionine gamma lyase is more resistant to protease than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more resistant to protease at pH 5, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more resistant to protease at pHs less than 5, than the methionine gamma lyase polypeptide of reference sequence of SEQ ID NO: 2, 94, 248, 352, 478, 832, 916, 1172, 1232, 1346, and/or 1488. In some embodiments, the protease resistance is to proteases trypsin, chymotrypsin, and/or pepsin. In some embodiments, the reference methionine gamma lyase polypeptide is the reference sequence of SEQ ID NO: 2.

In some embodiments, the recombinant methionine gamma lyase is more resistant to proteolysis than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more resistant to proteolysis at pH 5, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more resistant to proteolysis at pHs less than 5, than the methionine gamma lyase polypeptide of reference sequence of SEQ ID NO: 2, 94, 248, 352, 478, 832, 916, 1172, 1232, 1346, and/or 1488. In some embodiments the reference methionine gamma lyase polypeptide is the reference sequence of SEQ ID NO: 2.

In some embodiments, the recombinant methionine gamma lyase is more active in the presence of at least one bile salt than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt at pH 7, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt at pHs less than 7, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt at pH 5, than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase is more active in the presence of at least one bile salt stable at pHs less than 5, than the methionine gamma lyase polypeptide of reference sequence of SEQ ID NO: 2, 94, 248, 352, 478, 832, 916, 1172, 1232, 1346, and/or 1488. In some embodiments the reference methionine gamma lyase polypeptide is the reference sequence of SEQ ID NO: 2.

In yet some embodiments, the recombinant methionine gamma lyase is more stable at acidic pHs, more thermostable, more resistant to proteolysis, and/or more active in the presence of at least one bile salt than the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least one improved property selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments the reference methionine gamma lyase polypeptide is the reference sequence of SEQ ID NO: 2.

In some embodiments, the recombinant methionine gamma lyase exhibits at least one improved property selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least two improved properties selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least three improved properties selected from improved stability at acidic pHs, improved thermostability, improved resistance to proteolysis, and/or improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits the improved properties of improved stability at acidic pHs, improved thermostability, improved resistance to proteolysis, and improved activity in the presence of at least one bile salt, as compared to the methionine gamma lyase polypeptide of reference sequence of SEQ ID NO: 2, 94, 248, 352, 478, 832, 916, 1172, 1232, 1346, and/or 1488. In some embodiments, the recombinant methionine gamma lyase exhibits at least one improved property selected from improved stability at acidic pHs, improved thermostability, improved resistance to proteolysis, and/or improved activity in the presence of at least one bile salt, as well as at least one additional improved property, as compared to the methionine gamma lyase polypeptide of reference sequence of SEQ ID NO: 2, 94, 248, 352, 478, 832, 916, 1172, 1232, 1346, and/or 1488. In some embodiments of the foregoing, the acidic pH is a pH of 5 or pHs of less than 5. In some embodiments of the foregoing, the reference methionine gamma lyase polypeptide is the reference sequence of SEQ ID NO: 2.

In some embodiments, the recombinant methionine gamma lyase exhibits at least one improved property selected from: i) enhanced catalytic activity; ii) increased tolerance to acid pH; iii) increased tolerance to pH 5.2 or less; iv) increased tolerance to at least one protease; v) increased tolerance to at least one gastrointestinal protease; vi) increased tolerance to at least one bile salt; vii) increased thermotolerance; or a combination of any of i), ii), iii), iv), v), vi), vi), and vii) as compared to a reference methionine gamma lyase polypeptide. In some embodiments, the reference methionine gamma lyase polypeptide is sequence of SEQ ID NO: 2. In some alternative embodiments, the reference methionine gamma lyase polypeptide is a sequence selected from SEQ ID NO: 94, 248, 352, 478, 832, 916, 1172, 1232, 1346, and/or 1488. In some additional embodiments of the foregoing, the increased tolerance to pH is at pH 5.2. In some additional embodiments of the foregoing, the increased tolerance to pH is at pH 5. In some embodiments, the recombinant methionine gamma lyase exhibits at least two or at least three improved properties selected from: i) enhanced catalytic activity; ii) increased tolerance to acid pH; iii) increased tolerance to pH 5.2; iv) increased tolerance to at least one protease; v) increased tolerance to at least one gastrointestinal protease; vi) increased tolerance to at least one bile salt; vii) increased thermotolerance; or a combination of any of i), ii), iii), iv), v), vi), and vii) as compared to at least two or more reference methionine gamma lyase polypeptide. In some embodiments, the reference methionine gamma lyase polypeptide is a sequence selected from SEQ ID NOS: 2, 94, 248, 352, 478, 832, 916, 1172, 1232, 1346, and/or 1488.

Polynucleotides Encoding Engineered Polypeptides, Expression Vectors and Host Cells:

The present invention provides polynucleotides encoding the engineered polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered methionine gamma lyase polypeptides can be introduced into appropriate host cells to express the corresponding methionine gamma lyase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered methionine gamma lyase polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Tables 3-1, 3-2, 3-3, 3-4, 3-5, 3-6, 3-7, 3-8, 3-9, 3-10, 3-11, and 3-12.

In various embodiments, the codons are preferably selected to fit the host cell in which the protein is being produced. For example, preferred codons used in bacteria are used for expression in bacteria, while preferred codons used in fungi are used for expression in fungi. Consequently, codon optimized polynucleotides encoding the engineered methionine gamma lyase polypeptides contain preferred codons at about 40%, 50%, 60%, 70%, 80%, or greater than 90% of codon positions of the full length coding region.

In some embodiments, the present invention provides a recombinant polynucleotide having at least about 70%, about 75%, about 80%, about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 1, 93, 247, 351, 477, 831, 915, 1171, 1231, 1345, and/or 1487. In some embodiments, the recombinant polynucleotide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 1, 93, 247, 351, 477, 831, 915, 1171, 1231, 1345, and/or 1487. In some embodiments, the recombinant polynucleotide sequence has at least about 70%, about 75%, about 80%, about 85%, about 86%, about 87%, about 88%, about 89%, about 90%, about 91%, about 92%, about 93%, about 94%, about 95%, about 96%, about 97%, about 98%, about 99% or more sequence identity to an odd-numbered sequence of SEQ ID NOS: 1-1733. In some embodiments, the present invention provides a recombinant polynucleotide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1, 93, 247, 351, 477, 831, 915, 1171, 1231, 1345, 1487, and/or 1705. In some embodiments, the recombinant polynucleotide sequence has at least 80%, 85%, 86%, 87%, 88%, 89%, 90%, 91%, 92%, 93%, 94%, 95%, 96%, 97%, 98%, 99% or more sequence identity to the odd-numbered sequences of SEQ ID NOS: 1, 93, 247, 351, 477, 831, 915, 1171, 1231, 1345, 1487, and/or 1705.

In some embodiments, the polynucleotide encodes a recombinant methionine gamma lyase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set at one or more positions 2, 6/25/38/141/173/275/366/395, 6/25/55, 6/38/55/138, 6/38/55/138/141/288/308, 6/38/55/141/180/275/362, 6/38/55/141/180/288/362/366, 6/38/55/275/288/308, 6/38/138/141/173/288/366, 6/38/141/288/366, 6/55/138/173/366, 6/55/283/362/366, 6/180/362/366, 25/38/55/275/288, 25/180/288/362, 38/55/180/362/366, 38/55/362, 38/141/173/288/308/366, 38/141/308/362/366, 38/173, 54, 54/145, 55, 69, 69/138/140/189/199/336, 69/138/145/189/199/290/344, 69/138/165/189/290/296/322/336/344/398, 69/138/189/199/366, 69/138/189/336/344, 69/138/199/263/322/344/366, 69/138/336/366, 69/140/145/322/348, 69/140/165/189/322/366, 69/145/165/296/336/344/366, 69/145/165/322, 69/145/189/199/290, 69/145/189/366/398, 69/145/199/336/344, 69/145/322/344, 69/145/344, 69/165/189/199/263/336/366, 69/165/189/263/322/336, 69/165/263/290/336, 69/165/296/398, 69/165/322, 69/165/322/344/366, 69/165/344/366, 69/189/290/344/366, 69/189/322, 69/290/344, 69/322/344/398, 138/189/263/322/366, 140/145/189, 140/145/189/322/344/366, 140/165/296/322/336, 142, 145/189, 145/189/199/263/296/336/344/366, 145/189/199/322/344/398, 145/263/290/344/398, 145/290, 152, 165/189/199/322/366, 165/322/336, 165/336/344, 170, 173/366, 177, 179, 179/251, 189, 189/290/322/336/366, 189/290/322/344, 189/290/366, 189/322, 189/322/344, 193, 232, 267, 271, 275, 278, 287, 295, 296/344, 301, 304, 309, 322, 327, 333, 361, 366, 392, and 395, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set 2S, 2T, 6S/25E/38F/141E/173V/275A/366E/395D, 6S/25E/55P, 6S/38F/55P/138S/141E/288K/308A, 6S/38F/55P/138T, 6S/38F/55P/141E/180G/275A/362E, 6S/38F/55P/141E/180G/288K/362E/366E, 6S/38F/55P/275A/288K/308A, 6S/38F/138T/141E/173V/288K/366E, 6S/38F/141E/288K/366E, 6S/55P/138T/173V/366E, 6S/55P/283H/362E/366E, 6S/180G/362E/366E, 25E/38F/55P/275A/288K, 25E/180G/288K/362E, 38F/55P/180G/362E/366E, 38F/55P/362E, 38F/141E/173V/288K/308A/366E, 38F/141E/308A/362E/366E, 38F/173V, 54I, 54Q, 54R/145S, 55K, 69I, 69I/138C/140T/189L/199T/336H, 69I/138C/145G/189L/199T/290A/344T, 69I/138C/165R/189L/290A/296N/322A/336H/344C/398P, 69I/145G/165R/296N/336H/344T/366Q, 69I/145G/165R/322A, 69I/145G/189L/366Q/398P, 69I/145G/199T/336H/344T, 69I/145G/322Q/344C, 69I/145G/344C, 69I/165R/189L/263P/322Q/336H, 69I/165R/263P/290A/336H, 69I/165R/322Q, 69I/165R/322Q/344C/366Q, 69I/165R/344C/366Q, 69I/290A/344T, 69I/322A/344C/398P, 69W, 69W/138C/189L/199T/366Q, 69W/138C/189L/336H/344C, 69W/138C/199T/263P/322A/344C/366Q, 69W/138C/336H/366Q, 69W/140T/145G/322Q/348V, 69W/140T/165R/189L/322A/366Q, 69W/145G/189L/199T/290A, 69W/165R/189L/199T/263P/336H/366Q, 69W/165R/296N/398P, 69W/189L/290A/344T/366Q, 69W/189L/322A, 138C/189L/263P/322Q/366Q, 140T/145G/189L, 140T/145G/189L/322A/344C/366Q, 140T/165R/296N/322Q/336H, 142L, 142S, 145G/189L, 145G/189L/199T/263P/296N/336H/344T/366Q, 145G/189L/199T/322A/344T/398P, 145G/263P/290A/344T/398P, 145G/290A, 152A, 165R/189L/199T/322Q/366Q, 165R/322A/336H, 165R/336H/344T, 170P, 170W, 173V/366E, 177T, 179A, 179S/251N, 189L, 189L/290A/322Q/336H/366Q, 189L/290A/322Q/344T, 189L/290A/366Q, 189L/322A, 189L/322A/344C, 193S, 232P, 267T, 271D, 275N, 278C, 287V, 295G, 296G/344V, 301N, 304R, 309A, 322A, 322E, 322K, 327M, 333F, 361V, 366R, 392H, or 395H, wherein the amino acid positions of the polypeptide sequence are relative to the reference sequence of SEQ ID NO: 2. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the polypeptide sequence comprises at least one substitution or substitution set R2S, R2T, N6S/G25E/Y38F/Q141E/A173V/Q275A/H366E/K395D, N6S/G25E/G55P, N6S/Y38F/G55P/N138S/Q141E/L288K/R308A, N6S/Y38F/G55P/N138T, N6S/Y38F/G55P/Q141E/D180G/Q275A/Q362E, N6S/Y38F/G55P/Q141E/D180G/L288K/Q362E/H366E, N6S/Y38F/G55P/Q275A/L288K/R308A, N6S/Y38F/N138T/Q141E/A173V/L288K/H366E, N6S/Y38F/Q141E/L288K/H366E, N6S/G55P/N138T/A173V/H366E, N6S/G55P/Q283H/Q362E/H366E, N6S/D180G/Q362E/H366E, G25E/Y38F/G55P/Q275A/L288K, G25E/D180G/L288K/Q362E, Y38F/G55P/D180G/Q362E/H366E, Y38F/G55P/Q362E, Y38F/Q141E/A173V/L288K/R308A/H366E, Y38F/Q141E/R308A/Q362E/H366E, Y38F/A173V, E54I, E54Q, E54R/A145S, G55K, L69I, L69I/N138C/L140T/Y189L/E199T/S336H, L69I/N138C/A145G/Y189L/E199T/N290A/A344T, L69I/N138C/Q165R/Y189L/N290A/S296N/I322A/S336H/A344C/

A398P, L69I/A145G/Q165R/S296N/S336H/A344T/ H366Q, L69I/A145G/Q165R/I322A, L69I/A145G/Y189L/ H366Q/A398P, L69I/A145G/E199T/S336H/A344T, L69I/ A145G/I322Q/A344C, L69I/A145G/A344C, L69I/Q165R/ Y189L/A263P/I322Q/S336H, L69I/Q165R/A263P/ N290A/S336H, L69I/Q165R/I322Q, L69I/Q165R/I322Q/ A344C/H366Q, L69I/Q165R/A344C/H366Q, L69I/N290A/ A344T, L69I/I322A/A344C/A398P, L69W, L69W/N138C/ Y189L/E199T/H366Q, L69W/N138C/Y189L/S336H/ A344C, L69W/N138C/E199T/A263P/I322A/A344C/ H366Q, L69W/N138C/S336H/H366Q, L69W/L140T/ A145G/I322Q/A348V, L69W/L140T/Q165R/Y189L/ I322A/H366Q, L69W/A145G/Y189L/E199T/N290A, L69W/Q165R/Y189L/E199T/A263P/S336H/H366Q, L69W/Q165R/S296N/A398P, L69W/Y189L/N290A/ A344T/H366Q, L69W/Y189L/I322A, N138C/Y189L/ A263P/I322Q/H366Q, L140T/A145G/Y189L, L140T/ A145G/Y189L/I322A/A344C/H366Q, L140T/Q165R/ S296N/I322Q/S336H, A142L, A142S, A145G/Y189L, A145G/Y189L/E199T/A263P/S296N/S336H/A344T/ H366Q, A145G/Y189L/E199T/I322A/A344T/A398P, A145G/A263P/N290A/A344T/A398P, A145G/N290A, R152A, Q165R/Y189L/E199T/I322Q/H366Q, Q165R/ I322A/S336H, Q165R/S336H/A344T, A170P, A170W, A173V/H366E, R177T, H179A, H179S/D251N, Y189L, Y189L/N290A/I322Q/S336H/H366Q, Y189L/N290A/ I322Q/A344T, Y189L/N290A/H366Q, Y189L/I322A, Y189L/I322A/A344C, Y193S, D232P, D267T, A271D, Q275N, E278C, E287V, P295G, S296G/A344V, A301N, Q304R, L309A, I322A, I322E, I322K, R327M, Q333F, P361V, H366R, Q392H, or K395H, wherein the amino acid positions of the polypeptide sequence are relative to the reference sequence of SEQ ID NO: 2.

In some embodiments, the polynucleotide encodes a recombinant methionine gamma lyase comprising a polypeptide sequence having at least 80%, 85%, 86%, 87%, 88% 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set at one or more positions 38, 38/55, 38/55/150/189/290/ 322/361/366, 38/55/189, 38/55/189/275, 38/55/189/275/ 290/361, 38/55/189/278/361/366, 38/55/189/290/361/366, 38/55/189/304/322, 38/55/189/322, 38/55/189/322/366, 38/55/189/361, 38/55/275/278/290/361/366, 38/55/290/ 304/322/361/366, 38/55/304, 38/55/322/366, 38/149/189/ 275/322, 38/150/189/322/361/366, 38/189, 38/189/275/322/ 366, 38/189/290/322, 38/189/304/322, 38/189/304/366, 38/275, 38/278, 38/290, 38/290/322/361, 38/304, 38/322, 38/361, 38/366, 55, 55/189/322/361/366, 55/275, 55/275/ 366, 55/290/322, 55/304/366, 150/189/290, 189, 189/322, 278/366, and 388, wherein the amino acid positions of the polypeptide sequence are relative to the reference sequence of SEQ ID NO: 94. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set 38F, 38F/55E, 38F/55E/189L, 38F/55E/189L/275N/290N/361V, 38F/55E/189L/278C/361V/366E, 38F/55E/189L/322A, 38F/55E/304R, 38F/55H/189L/290N/361V/366E, 38F/55H/ 189L/361V, 38F/55H/290N/304R/322K/361V/366E, 38F/ 55K, 38F/55K/189L/275N, 38F/55K/189L/322A/366E, 38F/55K/322K/366E, 38F/55P/150T/189L/290N/322A/ 361V/366E, 38F/55P/189L/304R/322K, 38F/55P/189L/ 322A/366E, 38F/55P/275N/278C/290N/361V/366E, 38F/ 149T/189L/275N/322K, 38F/150T/189L/322K/361V/366E, 38F/189L, 38F/189L/275N/322K/366E, 38F/189L/290N/ 322K, 38F/189L/304R/322A, 38F/189L/304R/366E, 38F/ 275N, 38F/278C, 38F/290N, 38F/290N/322A/361V, 38F/ 304R, 38F/322A, 38F/361V, 38F/366E, 55H, 55H/275N, 55K, 55K/189L/322K/361V/366E, 55K/275N, 55K/275N/ 366E, 55K/290N/322A, 55K/304R/366E, 150T/189L/290N, 189L, 189L/322K, 278C/366E, or 388R, wherein the amino acid positions of the polypeptide sequence are relative to the reference sequence of SEQ ID NO: 94. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the polypeptide sequence comprises at least one substitution or substitution set Y38F, Y38F/G55E, Y38F/G55E/Y189L, Y38F/G55E/Y189L/Q275N/A290N/P361V, Y38F/G55E/ Y189L/E278C/P361V/H366E, Y38F/G55E/Y189L/I322A, Y38F/G55E/Q304R, Y38F/G55H/Y189L/A290N/P361V/ H366E, Y38F/G55H/Y189L/P361V, Y38F/G55H/A290N/ Q304R/I322K/P361V/H366E, Y38F/G55K, Y38F/G55K/ Y189L/Q275N, Y38F/G55K/Y189L/I322A/H366E, Y38F/ G55K/I322K/H366E, Y38F/G55P/K150T/Y189L/A290N/ I322A/P361V/H366E, Y38F/G55P/Y189L/Q304R/I322K, Y38F/G55P/Y189L/I322A/H366E, Y38F/G55P/Q275N/ E278C/A290N/P361V/H366E, Y38F/P149T/Y189L/ Q275N/I322K, Y38F/K150T/Y189L/I322K/P361V/H366E, Y38F/Y189L, Y38F/Y189L/Q275N/I322K/H366E, Y38F/ Y189L/A290N/I322K, Y38F/Y189L/Q304R/I322A, Y38F/ Y189L/Q304R/H366E, Y38F/Q275N, Y38F/E278C, Y38F/ A290N, Y38F/A290N/I322A/P361V, Y38F/Q304R, Y38F/ I322A, Y38F/P361V, Y38F/H366E, G55H, G55H/Q275N, G55K, G55K/Y189L/I322K/P361V/H366E, G55K/Q275N, G55K/Q275N/H366E, G55K/A290N/I322A, G55K/ Q304R/H366E, K150T/Y189L/A290N, Y189L, Y189L/ I322K, E278C/H366E, or A388R, wherein the amino acid positions of the polypeptide sequence are relative to the reference sequence of SEQ ID NO: 94.

In some embodiments, the polynucleotide encodes a recombinant methionine gamma lyase comprising a polypeptide sequence having at least 80%, 85%, 86%, 87%8, 8%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set at one or more positions 11, 29, 29/34/68/220/ 253/279/283/358, 29/34/279, 29/47/68/102/132/220/250/ 358, 29/47/279/283/358, 29/220, 34, 34/43/47/283, 34/68/ 132/253/283, 34/132/279/358, 38, 38/54/165/173/283/336, 38/54/173/283/322/336, 38/54/189/283, 38/54/283/336, 38/54/336, 38/165/173/189, 38/165/283, 38/173, 38/173/ 189/290, 38/173/189/290/322, 38/173/283/336, 38/173/322, 38/283, 38/322, 43/102, 47/126/237/279, 50, 54/165/173/ 290/322, 54/165/189/290/336, 54/173/283, 54/189/322, 58, 68, 68/283, 68/358, 87, 112, 126, 165/173/189/283, 165/ 189, 165/189/283/290/336, 173/189/283/336, 189, 220, 236, 240, 279, 290, 317, 334, 357, 358, 364, and 367, wherein the amino acid positions of the polypeptide sequence are relative to the reference sequence of SEQ ID NO: 248. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set 11A, 11C, 11G, 11H, 11M, 11R, 29T, 29T/34L/68D/220V/253M/279W/283H/358T, 29T/34L/ 279W, 29T/47G/68D/102A/132V/220V/250F/358T, 29T/ 47G/279W/283H/358T, 29T/220V, 34L, 34L/43A/47G/ 283H, 34L/68D/132V/253M/283H, 34L/132V/279W/358T, 38F, 38F/54Q/165R/173V/283H/336H, 38F/54Q/173V/ 283H/322A/336H, 38F/54Q/189L/283H, 38F/54Q/283H/ 336H, 38F/54Q/336H, 38F/165R/173V/189L, 38F/165R/ 283H, 38F/173V, 38F/173V/189L/290N, 38F/173V/189L/ 290N/322A, 38F/173V/283H/336H, 38F/173V/322A, 38F/ 283H, 38F/322A, 43A/102A, 47G/126A/237V/279W, 50L, 50M, 50V, 54Q/165R/173V/290N/322A, 54Q/165R/189L/ 290N/336H, 54Q/173V/283H, 54Q/189L/322A, 58T, 68D/ 283H, 68D/358T, 68G, 87G, 112A, 126E, 126R, 126S, 165R/173V/189L/283H, 165R/189L, 165R/189L/283H/ 290N/336H, 173V/189L/283H/336H, 189L, 220V, 236A, 236C, 240D, 240G, 240P, 240R, 279F, 290N, 290Q, 290V, 317R, 334V, 357A, 357G, 358L, 358T, 364L, or 367A, wherein the amino acid positions of the polypeptide sequence are relative to the reference sequence of SEQ ID NO: 248. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 248, or a functional fragment thereof, and wherein the polypeptide sequence comprises at least one substitution or substitution set S11A, S11C, S11G, S11H, S11M, S11R, V29T, V29T/Q34L/A68D/T220V/ S253M/H279W/Q283H/S358T, V29T/Q34L/H279W, V29T/A47G/A68D/R102A/I132V/T220V/H250F/S358T, V29T/A47G/H279W/Q283H/S358T, V29T/T220V, Q34L, Q34L/V43A/A47G/Q283H, Q34L/A68D/I132V/S253M/ Q283H, Q34L/I132V/H279W/S358T, Y38F, Y38F/E54Q/ Q165R/A173V/Q283H/S336H, Y38F/E54Q/A173V/ Q283H/I322A/S336H, Y38F/E54Q/Y189L/Q283H, Y38F/ E54Q/Q283H/S336H, Y38F/E54Q/S336H, Y38F/Q165R/ A173V/Y189L, Y38F/Q165R/Q283H, Y38F/A173V, Y38F/ A173V/Y189L/A290N, Y38F/A173V/Y189L/A290N/ I322A, Y38F/A173V/Q283H/S336H, Y38F/A173V/I322A, Y38F/Q283H, Y38F/I322A, V43A/R102A, A47G/G126A/ E237V/H279W, F50L, F50M, F50V, E54Q/Q165R/A173V/ A290N/I322A, E54Q/Q165R/Y189L/A290N/S336H, E54Q/A173V/Q283H, E54Q/Y189L/I322A, F58T, A68D/ Q283H, A68D/S358T, A68G, A87G, T112A, G126E, G126R, G126S, Q165R/A173V/Y189L/Q283H, Q165R/ Y189L, Q165R/Y189L/Q283H/A290N/S336H, A173V/ Y189L/Q283H/S336H, Y189L, T220V, L236A, L236C, K240D, K240G, K240P, K240R, H279F, A290N, A290Q, A290V, E317R, L334V, S357A, S357G, S358L, S358T, R364L, or H367A, wherein the amino acid positions of the polypeptide sequence are relative to the reference sequence of SEQ ID NO: 248.

In some embodiments, the polynucleotide encodes a recombinant methionine gamma lyase comprising a polypeptide sequence having at least 80%, 85%, 86%, 87%, 88%, 89%, 90%, 91%, 92%, 93% 94%, 95%, 96%, 97%, 98%, 99%, or more sequence identity to SEQ ID NO: 352, or a functional fragment thereof, and wherein the polypeptide sequence comprises at least one substitution or substitution set at one or more positions 11, 11/38, 11/38/50/54/ 126/189/322, 11/38/50/54/126/189/336/390/391, 11/38/50/ 54/126/240/290, 11/38/50/54/126/240/367, 11/38/50/54/ 250/290, 11/38/50/68, 11/38/50/126/189/240/250/290, 11/38/50/240, 11/38/50/290/367, 11/38/54, 11/38/54/68/ 126/290/336/367, 11/38/54/189/240/290, 11/38/54/189/290, 11/38/54/250/336, 11/38/68/189/240/290/367, 11/38/126/ 189/322/367, 11/38/126/322/336, 11/38/189, 11/38/189/ 240, 11/38/189/290/367, 11/38/189/322, 11/38/250/336, 11/38/290, 11/38/290/322, 11/38/290/322/336/367, 11/38/ 336, 11/50/68/126/290, 11/50/68/189/240, 11/50/68/290, 11/50/126, 11/50/240/250/290, 11/50/367, 11/54, 11/54/126, 11/54/189, 11/189/290/322, 11/240/250/290, 11/240/290, 11/290, 11/290/336, 11/322, 11/336, 11/394, 38/50/54/189/ 367, 38/54/236, 38/126/189/367, 38/126/240, 38/126/240/ 290, 50/54/68, 50/54/126/240/250/290, 50/54/240/322, 50/240, 68, 240, 322, and 336, wherein the amino acid positions of the polypeptide sequence are relative to the reference sequence of SEQ ID NO: 352. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set 11A/38F/50M/54Q/126A/189Y/322A, 11A/ 38F/50M/240R, 11A/38F/50M/290Q/367A, 11A/38F/54Q/ 68D/126A/290V/336H/367A, 11A/38F/54Q/189Y/240R/ 290V, 11A/38F/54Q/250F/336H, 11A/38F/126A/322A/ 336H, 11A/38F/189Y, 11A/38F/189Y/290V/367A, 11A/ 50M/68D/189Y/240R, 11A/50M/126A, 11A/50M/367A, 11A/54Q, 11A/54Q/189Y, 11A/189Y/290Q/322A, 11A/ 240R/290Q, 11C/38F/50M/54Q/126A/240R/290V, 11C/ 38F/50V/54Q/126A/240R/367A, 11C/38F/290Q, 11M, 11M/38F, 11M/38F/50M/54Q/126A/189Y/336H/390L/ 391E, 11M/38F/50M/54Q/250S/290Q, 11M/38F/50M/68D, 11M/38F/50M/126A/189Y/240R/250F/290Q, 11M/38F/ 50M/240R, 11M/38F/54Q, 11M/38F/54Q/189Y/290V, 11M/38F/68D/189Y/240R/290Q/367A, 11M/38F/126A/ 189Y/322A/367A, 11M/38F/189Y/240R, 11M/38F/189Y/ 322A, 11M/38F/250F/336H, 11M/38F/290Q/322A, 11M/ 38F/290Q/322A/336H/367A, 11M/38F/336H, 11M/50M/ 68D/126A/290Q, 11M/50M/68D/290Q, 11M/50V/240R/ 250S/290Q, 11M/54Q/126A, 11M/240R/250S/290Q, 11M/ 290V, 11M/290V/336H, 11M/322A, 11M/336H, 11M/394P, 38F/50V/54Q/189Y/367A, 38F/54Q/236A, 38F/126A/ 189Y/367A, 38F/126A/240R, 38F/126A/240R/290V, 50M/ 54Q/68D, 50M/54Q/126A/240R/250F/290Q, 50M/54Q/ 240R/322A, 50V/240R, 68D, 240R, 322A, or 336H, wherein the amino acid positions of the polypeptide sequence are relative to the reference sequence of SEQ ID NO: 352. In some embodiments, the recombinant methionine gamma lyase comprises a polypeptide sequence having at least 80%, 85%, 86%, 87%, 88% 89%, 90%, 91%, 92%, 93%, 94%, 95%, 96%, 97%, 98%, 99%, or more sequence identity to SEQ ID NO: 352, or a functional fragment thereof, and wherein the polypeptide sequence comprises at least one substitution or substitution set S11A/Y38F/F50M/ E54Q/G126A/L189Y/J322A, S11A/Y38F/F50M/K240R, S11A/Y38F/F50M/A290Q/H367A, S11A/Y38F/E54Q/ A68D/G126A/A290V/S336H/H367A, S11A/Y38F/E54Q/ L189Y/K240R/A290V, S11A/Y38F/E54Q/H250F/S336H, S11A/Y38F/G126A/I322A/S336H, S11A/Y38F/L189Y, S11A/Y38F/L189Y/A290V/H367A, S11A/F50M/A68D/ L189Y/K240R, S11A/F50M/G126A, S11A/F50M/H367A, S11A/E54Q, S11A/E54Q/L189Y, S11A/L189Y/A290Q/ I322A, S11A/K240R/A290Q, S11C/Y38F/F50M/E54Q/ G126A/K240R/A290V, S11C/Y38F/F50V/E54Q/G126A/ K240R/H367A, S11C/Y38F/A290Q, S11M, S11M/Y38F, S11M/Y38F/F50M/E54Q/G126A/L189Y/S336H/I390L/ D391E, S11M/Y38F/F50M/E54Q/H250S/A290Q, S11M/ Y38F/F50M/A68D, S11M/Y38F/F50M/G126A/L189Y/ K240R/H250F/A290Q, S11M/Y38F/F50M/K240R, S11M/ Y38F/E54Q, S11M/Y38F/E54Q/L189Y/A290V, S11M/ Y38F/A68D/L189Y/K240R/A290Q/H367A, S11M/Y38F/

G126A/L189Y/I322A/H367A, S11M/Y38F/L189Y/ K240R, S11M/Y38F/L189Y/I322A, S11M/Y38F/H250F/ S336H, S11M/Y38F/A290Q/I322A, S11M/Y38F/A290Q/ I322A/S336H/H367A, S11M/Y38F/S336H, S11M/F50M/ A68D/G126A/A290Q, S11M/F50M/A68D/A290Q, S11M/ F50V/K240R/H250S/A290Q, S11M/E54Q/G126A, S11M/ K240R/H250S/A290Q, S11M/A290V, S11M/A290V/ S336H, S11M/I322A, S11M/S336H, S11M/L394P, Y38F/ F50V/E54Q/L189Y/H367A, Y38F/E54Q/L236A, Y38F/ G126A/L189Y/H367A, Y38F/G126A/K240R, Y38F/ G126A/K240R/A290V, F50M/E54Q/A68D, F50M/E54Q/ G126A/K240R/H250F/A290Q, F50M/E54Q/K240R/ I322A, F50V/K240R, A68D, K240R, I322A, or S336, wherein the amino acid positions of the polypeptide sequence are relative to the reference sequence of SEQ ID NO: 352.

In some embodiments, the polynucleotide encodes a recombinant methionine gamma lyase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set at one or more positions 2/55/290/334/368, 2/271/ 290/322/368, 3/283/368, 3/368, 4/368, 5/368, 7/368, 8/368, 9/368, 21/368, 27/368, 30/368, 31/368, 32/368, 33/368, 35/368, 36/368, 46/368, 48/368, 49/368, 53/54/55/290/334/ 368, 53/54/55/290/368, 53/54/240/334/368, 53/54/275/279/ 334/336/368, 53/54/275/290/368, 53/54/290/368, 53/54/ 368, 53/240/334, 53/368, 54/55/236/279/290/334/368/392, 54/55/290/368, 54/179/368, 54/236/368, 54/240/388, 54/290/368, 55/236/290/368, 55/240/368, 60/368, 62/368, 66/368, 67/368, 69/368, 83/368, 91/368, 99/368, 111/195/ 368, 113/368, 119/368, 124/353/368, 124/368, 128/368, 146/368, 154/368, 156/368, 158/368, 160/368, 167/368, 173/368, 176/368, 179/279/368, 181/368, 183/368, 190/368, 195/368, 206/368, 209/368, 214/368, 219/368, 221/368, 225/368, 231/368, 236/279/368, 236/368, 239/368, 240/322, 240/334/392, 240/367, 240/368/388/392, 242/368, 243/368, 245/368, 247/368, 251/368, 256/298/368, 256/368, 259/368, 263/368, 269/368, 272/368, 279/368, 290/322/334/368, 290/ 322/334/368/392, 290/334/336/368, 290/334/368, 290/334/ 368/392, 290/368, 309/368, 312/368, 314/368, 315/368, 325/368, 333/334/368, 334/368, 334/368/388, 335/368, 338/ 368, 344/368, 368, 368/386, 368/388, 368/390, 368/391, and 368/392, wherein the amino acid positions of the polypeptide sequence are relative to the reference sequence of SEQ ID NO: 478. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set 2S/55E/290Q/334V/368D, 2S/271D/290Q/322K/368D, 3A/283N/368D, 3P/368D, 3S/368D, 4G/368D, 4R/368D, 5G/368D, 5H/368D, 5I/368D, 5K/368D, 5P/368D, 7E/368D, 7F/368D, 7G/368D, 7L/368D, 7V/368D, 8P/368D, 8R/368D, 8S/368D, 8Y/368D, 9A/368D, 21A/ 368D, 27S/368D, 30N/368D, 31A/368D, 32N/368D, 33A/ 368D, 33T/368D, 35G/368D, 35S/368D, 36S/368D, 46Q/ 368D, 48M/368D, 48R/368D, 49A/368D, 49T/368D, 53L/ 54Q/55H/290Q/334V/368D, 53L/54Q/55H/290V/368D, 53L/54Q/240R/334V/368D, 53L/54Q/275H/290V/368D, 53L/54Q/275N/279F/334V/336H/368D, 53L/54Q/290V/ 368D, 53L/54Q/368D, 53L/240R/334V, 53L/368D, 54Q/ 55H/236Y/279F/290Q/334V/368D/392H, 54Q/55H/290Q/ 368D, 54Q/179A/368D, 54Q/236Y/368D, 54Q/240R/388R, 54Q/290V/368D, 55H/236Y/290Q/368D, 55H/240R/368D, 60T/368D, 62A/368D, 62C/368D, 62H/368D, 66Q/368D, 66S/368D, 67A/368D, 67Q/368D, 67R/368D, 67V/368D, 69R/368D, 83S/368D, 91S/368D, 99A/368D, 111H/195S/ 368D, 113M/368D, 113T/368D, 119T/368D, 124A/368D, 124H/368D, 124R/353T/368D, 124S/368D, 124V/368D, 128H/368D, 146S/368D, 154V/368D, 156L/368D, 158S/ 368D, 160M/368D, 167T/368D, 173A/368D, 176V/368D, 179A/279F/368D, 181I/368D, 183V/368D, 190G/368D, 190L/368D, 195T/368D, 206I/368D, 209G/368D, 214C/ 368D, 219L/368D, 219V/368D, 221G/368D, 225C/368D, 231V/368D, 236Y/279F/368D, 236Y/368D, 239C/368D, 239T/368D, 239V/368D, 239Y/368D, 240R/322K, 240R/ 334V/392H, 240R/367A, 240R/368D/388R/392H, 242F/ 368D, 243C/368D, 243G/368D, 243S/368D, 245G/368D, 245S/368D, 247M/368D, 251A/368D, 256L/298V/368D, 256V/368D, 259L/368D, 263G/368D, 263K/368D, 263Q/ 368D, 263S/368D, 269S/368D, 272S/368D, 279F/368D, 290Q/322K/334V/368D, 290Q/322K/334V/368D/392H, 290Q/334V/368D, 290Q/334V/368D/392H, 290Q/368D, 290V/334V/336H/368D, 309A/368D, 312A/368D, 314L/ 368D, 315S/368D, 325A/368D, 333S/334V/368D, 334V/ 368D, 334V/368D/388R, 335I/368D, 338G/368D, 344A/ 368D, 344G/368D, 344R/368D, 344S/368D, 368D, 368D/ 386I, 368D/388R, 368D/390L, 368D/391N, or 368D/392H, wherein the amino acid positions of the polypeptide sequence are relative to the reference sequence of SEQ ID NO: 478. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 478, or a functional fragment thereof, and wherein the polypeptide sequence comprises at least one substitution or substitution set R2S/K55E/A290Q/ L334V/G368D, R2S/A271D/A290Q/I322K/G368D, D3A/ H283N/G368D, D3P/G368D, D3S/G368D, S4G/G368D, S4R/G368D, N5G/G368D, N5H/G368D, N5I/G368D, N5K/G368D, N5P/G368D, N7E/G368D, N7F/G368D, N7G/G368D, N7L/G368D, N7V/G368D, T8P/G368D, T8R/G368D, T8S/G368D, T8Y/G368D, G9A/G368D, P21A/G368D, A27S/G368D, P30N/G368D, P31A/G368D, V32N/G368D, Y33A/G368D, Y33T/G368D, T35G/G368D, T35S/G368D, A36S/G368D, G46Q/G368D, A48M/G368D, A48R/G368D, C49A/G368D, C49T/G368D, E53L/E54Q/ K55H/A290Q/L334V/G368D, E53L/E54Q/K55H/A290V/ G368D, E53L/E54Q/K240R/L334V/G368D, E53L/E54Q/ Q275H/A290V/G368D, E53L/E54Q/Q275N/H279F/ L334V/S336H/G368D, E53L/E54Q/A290V/G368D, E53L/ E54Q/G368D, E53L/K240R/L334V, E53L/G368D, E54Q/ K55H/L236Y/H279F/A290Q/L334V/G368D/Q392H, E54Q/K55H/A290Q/G368D, E54Q/H179A/G368D, E54Q/ L236Y/G368D, E54Q/K240R/A388R, E54Q/A290V/ G368D, K55H/L236Y/A290Q/G368D, K55H/K240R/ G368D, S60T/G368D, I62A/G368D, I62C/G368D, I62H/ G368D, T66Q/G368D, T66S/G368D, L67A/G368D, L67Q/ G368D, L67R/G368D, L67V/G368D, I69R/G368D, G83S/ G368D, G91S/G368D, T99A/G368D, R111H/Q195S/ G368D, L113M/G368D, L113T/G368D, A119T/G368D, G124A/G368D, G124H/G368D, G124R/S353T/G368D, G124S/G368D, G124V/G368D, F128H/G368D, A146S/ G368D, I154V/G368D, F156L/G368D, T158S/G368D, A160M/G368D, V167T/G368D, V173A/G368D, T176V/ G368D, H179A/H279F/G368D, L181I/G368D, I183V/ G368D, C190G/G368D, C190L/G368D, Q195T/G368D, V206I/G368D, A209G/G368D, S214C/G368D, I219L/ G368D, I219V/G368D, A221G/G368D, V225C/G368D, I231V/G368D, L236Y/H279F/G368D, L236Y/G368D, L239C/G368D, L239T/G368D, L239V/G368D, L239Y/G368D, K240R/I322K, K240R/L334V/Q392H, K240R/H367A, K240R/G368D/A388R/Q392H, M242F/G368D, T243C/G368D, T243G/G368D, T243S/G368D, A245G/G368D, A245S/G368D, L247M/G368D, D251A/G368D, M256L/A298V/G368D, M256V/G368D, I259L/G368D, A263G/G368D, A263K/G368D, A263Q/G368D, A263S/G368D, H269S/G368D, N272S/G368D, H279F/G368D, A290Q/I322K/L334V/G368D, A290Q/I322K/L334V/G368D/Q392H, A290Q/L334V/G368D, A290Q/L334V/G368D/Q392H, A290Q/G368D, A290V/L334V/S336H/G368D, L309A/G368D, G312A/G368D, I314L/G368D, A315S/G368D, G325A/G368D, Q333S/L334V/G368D, L334V/G368D, L334V/G368D/A388R, F335I/G368D, A338G/G368D, T344A/G368D, T344G/G368D, T344R/G368D, T344S/G368D, G368D, G368D/L386I, G368D/A388R, G368D/I390L, G368D/D391N, or G368D/Q392H, wherein the amino acid positions of the polypeptide sequence are relative to the reference sequence of SEQ ID NO: 478.

In some embodiments, the polynucleotide encodes a recombinant methionine gamma lyase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set at one or more positions 3/8, 8, 8/83/219/240/334/368, 8/219/272, 83, 119/315/334/368, 127/279/322, 173, 190, 206, 219, 219/263/334, 219/334/368, 263, 263/334, 272, 272/334/368, 279, 279/368, 315/334, 322, 322/368, 334, 334/368, and 368, wherein the amino acid positions of the polypeptide sequence are relative to the reference sequence of SEQ ID NO: 832. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set 3P/8S, 8S, 8S/83S/219V/240R/334L/368G, 8S/219V/272S, 83S, 119T/315S/334L/368G, 127Q/279F/322K, 173A, 190G, 206I, 219V, 219V/263G/334L, 219V/334L/368G, 263G, 263G/334L, 272S, 272S/334L/368G, 279F, 279F/368G, 315S/334L, 322K, 322K/368G, 334L, 334L/368G, or 368G, wherein the amino acid positions of the polypeptide sequence are relative to the reference sequence of SEQ ID NO: 832. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 832, or a functional fragment thereof, and wherein the polypeptide sequence comprises at least one substitution or substitution set D3P/T8S, T8S, T8S/G83S/I219V/K240R/V334L/D368G, T8S/I219V/N272S, G83S, A119T/A315S/V334L/D368G, E127Q/H279F/I322K, V173A, C190G, V206I, I219V, I219V/A263G/V334L, I219V/V334L/D368G, A263G, A263G/V334L, N272S, N272S/V334L/D368G, H279F, H279F/D368G, A315S/V334L, I322K, I322K/D368G, V334L, V334L/D368G, or D368G, wherein the amino acid positions of the polypeptide sequence are relative to the reference sequence of SEQ ID NO: 832.

In some embodiments, the polynucleotide encodes a recombinant methionine gamma lyase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set at one or more positions 3/57/173, 3/141/395, 5, 5/7, 5/7/54/57/344, 5/7/149, 5/41/272/279, 5/127/149/240/344/395, 5/141/178/240, 5/240, 5/240/272/298/344, 6, 7/41/149/344, 7/54/127/228/240/298/344, 7/57/141/279/298/395, 7/127/240, 7/178/240, 7/240, 7/240/272/395, 7/272, 23, 51, 54/57/344, 54/127/282, 54/272, 57, 57/127/344, 57/141/344, 57/240, 57/272, 57/298, 127, 127/149/240/298, 127/149/272/279/282/298/344, 127/240, 127/279/282/344, 127/344, 141, 141/149/344, 141/263/272/344, 141/279, 144, 149, 149/240/272, 149/272/282/298/344, 149/272/344/395, 149/282, 149/298, 149/344, 189, 190, 219, 223, 228, 229, 233/240/263/272/395, 239, 240, 240/263, 240/344, 252, 255, 256, 263, 270, 276, 279/282, 282, 284, 288, 298, 301, 315, 316, 323, 324, 335, 341, 344, 344/395, 362, 365, 384, 395, 396, and 398, wherein the amino acid positions of the polypeptide sequence are relative to the reference sequence of SEQ ID NO: 916. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set 3P/57Y/173A, 3P/141E/395D, 5H, 5H/7E, 5H/7E/54R/57Y/344A, 5H/7E/149D, 5H/41E/272S/279F, 5H/127K/149D/240R/344A/395D, 5H/141E/178A/240R, 5H/240R, 5H/240R/272S/298P/344A, 6L, 6R, 6S, 7E/41E/149D/344A, 7E/54R/127K/228A/240R/298P/344A, 7E/57Y/141E/279F/298P/395D, 7E/127K/240R, 7E/178A/240R, 7E/240R, 7E/240R/272S/395D, 7E/272S, 23K, 51K, 51N, 51S, 54R/57Y/344A, 54R/127K/282A, 54R/272S, 57Y, 57Y/127K/344A, 57Y/141E/344A, 57Y/240R, 57Y/272S, 57Y/298P, 127A, 127K, 127K/149D/240R/298P, 127K/149D/272S/279F/282A/298P/344A, 127K/240R, 127K/279F/282A/344A, 127K/344A, 127V, 141E, 141E/149D/344A, 141E/263A/272S/344A, 141E/279F, 141G, 141P, 141R, 141S, 141T, 144R, 149D, 149D/240R/272S, 149D/272S/282A/298P/344A, 149D/272S/344A/395D, 149D/282A, 149D/298P, 149D/344A, 149T, 189I, 190A, 219L, 223I, 228R, 229H, 229S, 233Q/240R/263A/272S/395D, 239K, 240R, 240R/263A, 240R/344A, 252C, 255V, 256L, 263A, 270S, 276I, 276L, 279F/282A, 282A, 282N, 282V, 284A, 284S, 288A, 288G, 288I, 288M, 288Q, 288R, 288S, 288T, 288W, 298G, 298K, 298P, 298S, 301D, 301E, 301K, 301Q, 315S, 316L, 323K, 323T, 324S, 335I, 341F, 344A, 344A/395D, 362R, 365K, 384S, 395D, 395R, 396R, 396V, 398G, or 398Q, wherein the amino acid positions of the polypeptide sequence are relative to the reference sequence of SEQ ID NO: 916. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 916, or a functional fragment thereof, and wherein the polypeptide sequence comprises at least one substitution or substitution set D3P/H57Y/V173A, D3P/Q141E/K395D, N5H, N5H/N7E, N5H/N7E/E54R/H57Y/T344A, N5H/N7E/P149D, N5H/P41E/N272S/H279F, N5H/E127K/P149D/K240R/T344A/K395D, N5H/Q141E/G178A/K240R, N5H/K240R, N5H/K240R/N272S/A298P/T344A, N6L, N6R, N6S, N7E/P41E/P149D/T344A, N7E/E54R/E127K/K228A/K240R/A298P/T344A, N7E/H57Y/Q141E/H279F/A298P/K395D, N7E/E127K/K240R, N7E/G178A/K240R, N7E/K240R, N7E/

K240R/N272S/K395D, N7E/N272S, S23K, A51K, A51N, A51S, E54R/H57Y/T344A, E54R/E127K/R282A, E54R/ N272S, H57Y, H57Y/E127K/T344A, H57Y/Q141E/ T344A, H57Y/K240R, H57Y/N272S, H57Y/A298P, E127A, E127K, E127K/P149D/K240R/A298P, E127K/ P149D/N272S/H279F/R282A/A298P/T344A, E127K/ K240R, E127K/H279F/R282A/T344A, E127K/T344A, E127V, Q141E, Q141E/P149D/T344A, Q141E/G263A/ N272S/T344A, Q141E/H279F, Q141G, Q141P, Q141R, Q141S, Q141T, K144R, P149D, P149D/K240R/N272S, P149D/N272S/R282A/A298P/T344A, P149D/N272S/ T344A/K395D, P149D/R282A, P149D/A298P, P149D/ T344A, P149T, L189I, C190A, V219L, L223I, K228R, A229H, A229S, R233Q/K240R/G263A/N272S/K395D, L239K, K240R, K240R/G263A, K240R/T344A, A252C, L255V, M256L, G263A, C270S, V276I, V276L, H279F/ R282A, R282A, R282N, R282V, P284A, P284S, L288A, L288G, L288I, L288M, L288Q, L288R, L288S, L288T, L288W, A298G, A298K, A298P, A298S, A301D, A301E, A301K, A301Q, A315S, F316L, E323K, E323T, A324S, F335I, L341F, T344A, T344A/K395D, Q362R, A365K, D384S, K395D, K395R, A396R, A396V, A398G, or A398Q, wherein the amino acid positions of the polypeptide sequence are relative to the reference sequence of SEQ ID NO: 916.

In some embodiments, the polynucleotide encodes a recombinant methionine gamma lyase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set at one or more positions 23/219/223/276/288/298/ 301/365, 23/219/239/341, 23/219/240/276/279, 23/219/240/ 276/279/298, 23/219/240/276/298/324, 23/219/276/298, 23/219/276/341, 23/219/298/341, 23/239/240/255/276/279/ 298/324, 23/239/255/276/279/335/341, 23/240/255/276/ 324/335, 23/240/255/279, 23/240/276/298, 23/255/276/298, 23/263/276/279/282/298/341, 23/276/282/335, 23/276/298/ 324, 23/276/298/324/335, 23/279/282/335/396, 23/279/335, 23/341, 219/223/240/279, 219/223/276/298/341/396, 219/ 223/276/335, 219/240, 219/240/276/335, 219/276/279/282, 219/276/279/298/301, 219/276/298/324/335, 219/276/335, 219/279/341, 223/229/279/335, 223/255, 223/335/365, 229/ 255/276/282/341, 239/240/255/276/298/316/335, 239/240/ 276/316, 239/240/276/341, 239/279/298/335/341, 239/279/ 341, 240, 240/276/279, 240/279, 240/298, 255/298/341, 263/270/276, 276/279/298/316, 276/279/324/335/341, 276/ 298/324/335, 276/335/341, 276/341, 279/341, 298/301, 298/ 341, 335, and 341, wherein the amino acid positions of the polypeptide sequence are relative to the reference sequence of SEQ ID NO: 1172. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set 23K/ 219L/223I/276I/288I/298K/301Q/365K, 23K/219L/239K/ 341F, 23K/219L/240R/276I/279F, 23K/219L/240R/276I/ 279F/298K, 23K/219L/240R/276I/298K/324S, 23K/219L/ 276I/298K, 23K/219L/276I/341F, 23K/219L/298K/341F, 23K/239K/240R/255V/276I/279F/298P/324S, 23K/239K/ 255V/276I/279F/335I/341F, 23K/240R/255V/276I/324S/ 335I, 23K/240R/255V/279F, 23K/240R/276I/298K, 23K/ 255V/276I/298K, 23K/263A/276I/279F/282A/298K/341F, 23K/276I/282A/335I, 23K/276I/298K/324S, 23K/276I/ 298K/324S/335I, 23K/279F/282A/335I/396V, 23K/279F/ 335I, 23K/341F, 219L/223I/240R/279F, 219L/223I/276I/ 298P/341F/396V, 219L/223I/276I/335I, 219L/240R, 219L/ 240R/276I/335I, 219L/276I/279F/282A, 219L/276I/279F/ 298K/301Q, 219L/276I/298K/324S/335I, 219L/276I/335I, 219L/279F/341F, 223I/229S/279F/335I, 223I/255V, 223I/ 335I/365K, 229S/255V/276I/282A/341F, 239K/240R/ 255V/276I/298P/316L/335I, 239K/240R/276I/316L, 239K/ 240R/276I/341F, 239K/279F/298K/335I/341F, 239K/279F/ 341F, 240R, 240R/276I/279F, 240R/279F, 240R/298K, 255V/298K/341F, 263A/270S/276I, 276I/279F/298P/316L, 276I/279F/324S/335I/341F, 276I/298K/324S/335I, 276I/ 335I/341F, 276I/341F, 279F/341F, 298P/301Q, 298P/341F, 335I, or 341F, wherein the amino acid positions of the polypeptide sequence are relative to the reference sequence of SEQ ID NO: 1172. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1172, or a functional fragment thereof, and wherein the polypeptide sequence comprises at least one substitution or substitution set S23K/ V219L/L223I/V276I/L288I/A298K/A301Q/A365K, S23K/ V219L/L239K/L341F, S23K/V219L/K240R/V276I/H279F, S23K/V219L/K240R/V276I/H279F/A298K, S23K/V219L/ K240R/V276I/A298K/A324S, S23K/V219L/V276I/ A298K, S23K/V219L/V276I/L341F, S23K/V219L/A298K/ L341F, S23K/L239K/K240R/L255V/V276I/H279F/A298P/ A324S, S23K/L239K/L255V/V276I/H279F/F335I/L341F, S23K/K240R/L255V/V276I/A324S/F335I, S23K/K240R/ L255V/H279F, S23K/K240R/V276I/A298K, S23K/L255V/ V276I/A298K, S23K/G263A/V276I/H279F/R282A/ A298K/L341F, S23K/V276I/R282A/F335I, S23K/V276I/ A298K/A324S, S23K/V276I/A298K/A324S/F335I, S23K/ H279F/R282A/F335I/A396V, S23K/H279F/F335I, S23K/ L341F, V219L/L223I/K240R/H279F, V219L/L223I/V276I/ A298P/L341F/A396V, V219L/L223I/V276I/F335I, V219L/ K240R, V219L/K240R/V276I/F335I, V219L/V276I/ H279F/R282A, V219L/V276I/H279F/A298K/A301Q, V219L/V276I/A298K/A324S/F335I, V219L/V276I/F335I, V219L/H279F/L341F, L223I/A229S/H279F/F335I, L223I/ L255V, L223I/F335I/A365K, A229S/L255V/V276I/ R282A/L341F, K239K/K240R/L255V/V276I/A298P/ F316L/F335I, L239K/K240R/V276I/F316L, L239K/ K240R/V276I/L341F, L239K/H279F/A298K/F335I/L341F, L239K/H279F/L341F, K240R, K240R/V276I/H279F, K240R/H279F, K240R/A298K, L255V/A298K/L341F, G263A/C270S/V276I, V276I/H279F/A298P/F316L, V276I/H279F/A324S/F335I/L341F, V276I/A298K/A324S/ F335I, V276I/F335I/L341F, V276I/L341F, H279F/L341F, A298P/A301Q, A298P/L341F, F335I, or L341F, wherein the amino acid positions of the polypeptide sequence are relative to the reference sequence of SEQ ID NO: 1172.

In some embodiments, the polynucleotide encodes a recombinant methionine gamma lyase comprising a polypeptide sequence having at least 80%, 85%, 86%, 87%, 88% 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set at one or more positions 2, 3, 4, 5, 7, 8, 17, 47, 50, 55, 132, 134, 145, 170, 174, 179, 223, 223/239, 223/239/240, 223/239/240/279/335, 223/239/255/316, 223/239/298/316, 223/239/316/335, 223/240/298, 223/255, 223/255/298, 223/ 255/298/316, 223/255/335, 223/279/298, 223/279/298/335, 223/279/335, 223/288, 223/288/298, 223/298, 223/316, 223/ 335, 236, 237, 239, 239/279/298/316, 239/288, 240/255, 240/279, 240/288/335, 255, 255/279, 255/298, 255/335, 267, 275, 279, 279/298/335, 287, 288, 290/295, 295, 298, 298/335, 309, 316, 322, 333, 358, and 383, wherein the amino acid positions of the polypeptide sequence are relative to the reference sequence of SEQ ID NO: 1232. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set 2K, 2W, 3E, 3S, 4E, 4V, 5T, 7L, 7S, 8G, 8P, 8S, 17C, 47Q, 50M, 55E, 55N, 55P, 55S, 132V, 134F, 145G, 145S, 170G, 170Q, 174E, 179W, 223I, 223I/239K, 223I/239K/240R, 223I/239K/240R/279F/335I, 223I/239K/255V/316L, 223I/239K/298K/316L, 223I/239K/316L/335I, 223I/240R/298S, 223I/255V, 223I/255V/298K, 223I/255V/298K/316L, 223I/255V/335I, 223I/279F/298S, 223I/279F/298S/335I, 223I/279F/335I, 223I/288I, 223I/288I/298K, 223I/298S, 223I/316L, 223I/335I, 236R, 237A, 237G, 237H, 237K, 237L, 237R, 237V, 237Y, 239K, 239K/279F/298K/316L, 239K/288I, 240R/255V, 240R/279F, 240R/288I/335I, 255V, 255V/279F, 255V/298P, 255V/335I, 267N, 267R, 275R, 275S, 279F, 279F/298K/335I, 287D, 288I, 290K/295S, 295E, 298K, 298K/335I, 309A, 309K, 316L, 322V, 333T, 358C, 358K, 358R, or 383I, wherein the amino acid positions of the polypeptide sequence are relative to the reference sequence of SEQ ID NO: 1232. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1232, or a functional fragment thereof, and wherein the polypeptide sequence comprises at least one substitution or substitution set R2K, R2W, D3E, D3S, S4E, S4V, N5T, N7L, N7S, T8G, T8P, T8S, H17C, A47Q, F50M, K55E, K55N, K55P, K55S, I132V, H134F, A145G, A145S, A170G, A170Q, D174E, H179W, L223I, L223I/L239K, L223I/L239K/K240R, L223I/L239K/K240R/H279F/F335I, L223I/L239K/L255V/F316L, L223I/L239K/A298K/F316L, L223I/L239K/F316L/F335I, L223I/K240R/A298S, L223I/L255V, L223I/L255V/A298K, L223I/L255V/A298K/F316L, L223I/L255V/F335I, L223I/H279F/A298S, L223I/H279F/A298S/F335I, L223I/H279F/F335I, L223I/L288I, L223I/L288I/A298K, L223I/A298S, L223I/F316L, L223I/F335I, L236R, E237A, E237G, E237H, E237K, E237L, E237R, E237V, E237Y, L239K, L239K/H279F/A298K/F316L, L239K/L288I, K240R/L255V, K240R/H279F, K240R/L288I/F335I, L255V, L255V/H279F, L255V/A298P, L255V/F335I, D267N, D267R, Q275R, Q275S, H279F, H279F/A298K/F335I, E287D, L288I, Q290K/P295S, P295E, A298K, A298K/F335I, L309A, L309K, F316L, I322V, Q333T, S358C, S358K, S358R, or V383I, wherein the amino acid positions of the polypeptide sequence are relative to the reference sequence of SEQ ID NO: 1232.

In some embodiments, the polynucleotide encodes a recombinant methionine gamma lyase comprising a polypeptide sequence having at least 80%, 85%, 86%, 87%, 88% 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set at one or more positions 5, 5/8/50/132, 5/8/55/132/236/237, 5/8/236/237/267, 5/50, 5/50/236/237/267, 5/55/132, 5/236/237, 8, 8/50, 8/50/55/132/237, 8/50/237, 8/55, 8/55/236/237/267, 8/55/267, 8/132/236, 8/236/237, 8/237, 8/237/ 267, 11/23/276/279/368, 11/368, 23/57/141/223, 50, 50/55/132/237/267, 50/132/180/237, 50/132/236, 50/132/237/267, 50/236/237, 55/132, 55/132/236/237, 55/132/237, 55/236/237, 55/236/237/267, 55/267, 57, 132, 132/236/237, 132/267, 173/263/283/368, 189/368, 219, 219/223/276/279/283/368, 223/368, 236, 236/237, 236/237/267, 237, 237/267, 263, and 283, wherein the amino acid positions of the polypeptide sequence are relative to the reference sequence of SEQ ID NO: 1346. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set 5T, 5T/8S/50M/132V, 5T/8S/55A/132V/236R/237T, 5T/8S/236R/237H/267E, 5T/50M, 5T/50M/236R/237T/267E, 5T/55S/132V, 5T/236R/237H, 8S, 8S/50M, 8S/50M/55P/132V/237H, 8S/50M/237K, 8S/55A/267E, 8S/55S, 8S/55S/236R/237K/267E, 8S/132V/236R, 8S/236R/237G, 8S/236R/237K, 8S/237H, 8S/237R, 8S/237R/267E, 11S/23S/276V/279H/368G, 11S/368G, 23S/57H/141Q/223L, 50M, 50M/55P/132V/237G/267E, 50M/132V/180V/237H, 50M/132V/236R, 50M/132V/237T/267E, 50M/236R/237R, 55A/236R/237K, 55P/132V/237H, 55P/267E, 55S/132V, 55S/132V/236R/237H, 55S/236R/237T/267E, 57H, 132V, 132V/236R/237A, 132V/267E, 173A/263A/283Q/368G, 189Y/368G, 219I, 219I/223L/276V/279H/283Q/368G, 223L/368G, 236R, 236R/237H/267E, 236R/237R, 237H, 237H/267E, 263A, or 283Q, wherein the amino acid positions of the polypeptide sequence are relative to the reference sequence of SEQ ID NO: 1346. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1346, or a functional fragment thereof, and wherein the polypeptide sequence comprises at least one substitution or substitution set N5T, N5T/T8S/F50M/I132V, N5T/T8S/K55A/I132V/L236R/E237T, N5T/T8S/L236R/E237H/D267E, N5T/F50M, N5T/F50M/L236R/E237T/D267E, N5T/K55S/I132V, N5T/L236R/E237H, T8S, T8S/F50M, T8S/F50M/K55P/I132V/E237H, T8S/F50M/E237K, T8S/K55A/D267E, T8S/K55S, T8S/K55S/L236R/E237K/D267E, T8S/I132V/L236R, T8S/L236R/E237G, T8S/L236R/E237K, T8S/E237H, T8S/E237R, T8S/E237R/D267E, M11S/K23S/I276V/F279H/D368G, M11S/D368G, K23S/Y57H/E141Q/I223L, F50M, F50M/K55P/I132V/E237G/D267E, F50M/I132V/D180V/E237H, F50M/I132V/L236R, F50M/I132V/E237T/D267E, F50M/L236R/E237R, K55A/L236R/E237K, K55P/I132V/E237H, K55P/D267E, K55S/I132V, K55S/I132V/L236R/E237H, K55S/L236R/E237T/D267E, Y57H, I132V, I132V/L236R/E237A, I132V/D267E, V173A/G263A/H283Q/D368G, L189Y/D368G, L219I, L219I/I223L/I276V/F279H/H283Q/D368G, I223L/D368G, L236R, L236R/E237H/D267E, L236R/E237R, E237H, E237H/D267E, G263A, or H283Q, wherein the amino acid positions of the polypeptide sequence are relative to the reference sequence of SEQ ID NO: 1346.

In some embodiments, the polynucleotide encodes a recombinant methionine gamma lyase comprising a polypeptide sequence having at least 80%, 85%, 86%, 87%, 88% 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set at one or more positions 6, 9, 63, 69, 82, 93, 126, 141, 155, 175, 189, 199, 220, 221, 229, 230, 233, 253, 254, 282, 284, 298, 300, 301, 304, 308, 323, 362, 365, 384, 395, 396, and 398, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set 6P, 9R, 63G, 69V, 82C, 93L, 126R, 141V, 155F, 175V, 189P, 189S, 199W, 220I, 221G, 229G, 230V, 233G, 233M, 233Q, 233S, 233V, 253G, 254A, 282Q, 284E, 284S, 284V, 298C, 298G, 298N, 298R, 300R, 301G, 301S, 304K, 304V, 308K, 308L, 308S, 323S, 362E, 365R, 384A, 384G, 384Q, 395A, 395R, 396Q, 396R, or 398G, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set N6P, G9R, S63G, I69V, A82C, I93L, G126R, E141V, Y155F, A175V, L189P, L189S, E199W, T220I, A221G, A229G, L230V, R233G, R233M, R233Q, R233S, R233V, S253G, L254A, R282Q, P284E, P284S, P284V, S298C, S298G, S298N, S298R, Y300R, A301G, A301S, R304K, R304V, R308K, R308L, R308S, E323S, Q362E, A365R, D384A, D384G, D384Q, K395A, K395R, A396Q, A396R, or A398G, wherein the amino acid positions of the polypeptide sequence are relative to the reference sequence of SEQ ID NO: 1488.

In some embodiments, the polynucleotide encodes a recombinant methionine gamma lyase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set at one or more positions 189/230/233/298/395/398, 230, 230/233/281, 230/233/298/301/362/384/395, 230/233/298/301/395, 230/233/298/362, 230/233/308/384/395, 230/233/362/395, 230/233/384/395, 230/233/384/395/398, 230/362/395, 233, 233/298/301/362, 233/298/308/384/395, 233/298/362, 233/362, 233/362/395, 233/362/395/398, 233/384/395, 233/395, 298, 298/301, 298/301/308/384, 298/362/384, 362/384, 384/398, 395/398, and 398, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set 189M/230V/233S/298N/395R/398G, 230V, 230V/233M/298N/301S/395R, 230V/233M/362E/395R, 230V/233M/384G/395R, 230V/233Q/281V, 230V/233Q/298N/301S/395R, 230V/233Q/298N/362E, 230V/233Q/298R/301S/362E/384G/395R, 230V/233Q/298R/301S/395R, 230V/233Q/308K/384G/395R, 230V/233Q/384G/395R/398G, 230V/233S/298N/301S/362E/384G/395R, 230V/362E/395R, 233G/395R, 233M, 233M/298N/308K/384G/395R, 233M/298N/362E, 233M/362E/395R/398G, 233Q, 233Q/298N/301S/362E, 233Q/298R/362E, 233Q/384G/395R, 233S/362E, 233S/362E/395R, 233S/384G/395R, 298N/301S/308K/384G, 298N/362E/384G, 298R, 298Y/301S, 362E/384G, 384G/398G, 395R/398G, or 398G, wherein the amino acid positions of the polypeptide sequence are relative to the reference sequence of SEQ ID NO: 1488. In some embodiments, the recombinant methionine gamma lyase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1488, or a functional fragment thereof, and wherein the polypeptide sequence comprises at least one substitution or substitution set L189M/L230V/R233S/S298N/K395R/A398G, L230V, L230V/R233M/S298N/A301S/K395R, L230V/R233M/Q362E/K395R, L230V/R233M/D384G/K395R, L230V/R233Q/A281V, L230V/R233Q/S298N/A301S/K395R, L230V/R233Q/S298N/Q362E, L230V/R233Q/S298R/A301S/Q362E/D384G/K395R, L230V/R233Q/S298R/A301S/K395R, L230V/R233Q/R308K/D384G/K395R, L230V/R233Q/D384G/K395R/A398G, L230V/R233S/S298N/A301S/Q362E/D384G/K395R, L230V/Q362E/K395R, R233G/K395R, R233M, R233M/S298N/R308K/D384G/K395R, R233M/S298N/Q362E, R233M/Q362E/K395R/A398G, R233Q, R233Q/S298N/A301S/Q362E, R233Q/S298R/Q362E, R233Q/D384G/K395R, R233S/Q362E, R233S/Q362E/K395R, R233S/D384G/K395R, S298N/A301S/R308K/D384G, S298N/Q362E/D384G, S298R, S298Y/A301S, Q362E/D384G, D384G/A398G, K395R/A398G, or A398G, wherein the amino acid positions of the polypeptide sequence are relative to the reference sequence of SEQ ID NO: 1488.

In some embodiments, as described above, the polynucleotide encodes an engineered polypeptide having methionine gamma lyase activity with the properties disclosed herein, wherein the polypeptide comprises an polypeptide sequence having at least 80%, 81%, 82%, 83%, 84%, 85%, 86%, 87%, 88%, 89%, 90%, 91%, 92%, 93%, 94%, 95%, 96%, 97%, 98%, 99% or more identity to a reference sequence (e.g., SEQ ID NO: 2, 94, 248, 352, 478, 832, 916, 1172, 1232, 1346, and/or 1488), or the polypeptide sequence of any variant as disclosed in Table 3-1, 3-2, 3-3, 3-4, 3-5, 3-6, 3-7, 3-8, 3-9, 3-10, 3-11, and/or 3-12, and one or more residue differences as compared to the reference polypeptide of SEQ ID NO: 2, 94, 248, 352, 478, 832, 916, 1172, 1232, 1346, and/or 1488, or the polypeptide sequence of any variant as disclosed in the Tables (for example 1, 2, 3, 4, 5, 6, 7, 8, 9, 10 or more amino acid residue positions). In some embodiments, the polynucleotide encodes an engineered polypeptide having methionine gamma lyase activity with the properties disclosed herein, wherein the polypeptide comprises an polypeptide sequence having at least 80%, 81%, 82%, 83%, 84%, 85%, 86%, 87%, 88%, 89%, 90%, 91%, 92%, 93% 94%, 95%, 96%, 97%, 98%, 99% or more sequence identity to at least one reference sequence selected from SEQ ID NO: 2, 94, 248, 352, 478, 832, 916, 1172, 1232, 1346, and/or 1488, and one or more residue differences as compared to SEQ ID NO: 2, 94, 248, 352, 478, 832, 916, 1172, 1232, 1346, and/or 1488, at residue positions selected from those provided in Table 3-1, 3-2, 3-3, 3-4, 3-5, 3-6, 3-7, 3-8, 3-9, 3-10, 3-11, and/or 3-12, when optimally aligned with the polypeptide of SEQ ID NO: 2, 94, 248, 352, 478, 832, 916, 1172, 1232, 1346, and/or 1488.

In some additional embodiments, the polynucleotide comprises a sequence having at least about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99% or more sequence identity to reference sequence SEQ ID NO: 1, 93, 247, 351, 477, 831, 915, 1171, 1231, 1345, and/or 1487. In some additional embodiments, the polynucleotide comprises a sequence having at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99% or more sequence identity to at least one polynucleotide sequence provided in Table 3-1, 3-2, 3-3, 3-4, 3-5, 3-6, 3-7, 3-8, 3-9, 3-10, 3-11, and/or 3-12. In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence selected from SEQ ID NO: 1, 93, 247, 351, 477, 831, 915, 1171, 1231, 1345, and/or 1487. In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence provided in Table 3-1, 3-2, 3-3, 3-4, 3-5, 3-6, 3-7, 3-8, 3-9, 3-10, 3-11, and/or 3-12. In some embodiments, the polynucleotide encoding the engineered methionine gamma lyase polypeptides comprises the polynucleotide sequence of SEQ ID NO: 1, 93, 247, 351, 477, 831, 915, 1171, 1231, 1345, and/or 1487.

In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence which is an odd-numbered sequence of SEQ ID NOS: 1-1733 or 3-1733. In some embodiments, the polynucleotide comprises a nucleic acid sequence of an odd numbered sequence of SEQ ID NOS: 1-1733 or 3-1733.

In some embodiments, the polynucleotide comprises a sequence of an odd numbered sequence of SEQ ID NOS: 3-205. In some embodiments, the polynucleotide comprises a sequence of an odd numbered sequence of SEQ ID NOS: 207-297. In some embodiments, the polynucleotide comprises a sequence of an odd numbered sequence of SEQ ID NOS: 299-443. In some embodiments, the polynucleotide comprises a sequence of an odd numbered sequence of SEQ ID NOS: 445-561. In some embodiments, the polynucleotide comprises a sequence of an odd numbered sequence of SEQ ID NOS: 563-877. In some embodiments, the polynucleotide comprises a sequence of an odd numbered sequence of SEQ ID NOS: 879-927. In some embodiments, the polynucleotide comprises a sequence of an odd numbered sequence of SEQ ID NOS: 929-1173. In some embodiments, the polynucleotide comprises a sequence of an odd numbered sequence of SEQ ID NOS: 1175-1285. In some embodiments, the polynucleotide comprises a sequence of an odd numbered sequence of SEQ ID NOS: 1287-1459. In some embodiments, the polynucleotide comprises a sequence of an odd numbered sequence of SEQ ID NOS: 1461-1563. In some embodiments, the polynucleotide comprises a sequence of an odd numbered sequence of SEQ ID NOS: 1565-1665. In some embodiments, the polynucleotide comprises a sequence of an odd numbered sequence of SEQ ID NOS: 1667-1733. In some embodiments, the foregoing polynucleotides encode a recombinant methionine gamma lyase polypeptide, wherein the polypeptide sequence of the polypeptide has optionally 1, 2, 3, 4, 5, 6, 7, 8, 9, or up to 10 substitutions in the polypeptide sequence. In some embodiments, the encoded recombinant methionine gamma lyase polypeptide includes 1, 2, 3, 4, up to 5 substitutions in the polypeptide sequence. In some embodiments, the encoded recombinant methionine gamma lyase polypeptide includes 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions.

In some embodiments, the polynucleotide comprises the sequence of SEQ ID NO: 93, 247, 351, 477, 831, 915, 1171, 1231, 1345, 1487 or 1705. In some embodiments, the polynucleotide encodes a recombinant methionine gamma lyase, where the polypeptide sequence has optionally 1, 2, 3, 4, 5, 6, 7, 8, 9, or up to 10 substitutions in the foregoing polypeptide sequence. In some embodiments, the encoded recombinant methionine gamma lyase polypeptide includes 1, 2, 3, 4, up to 5 substitutions in the polypeptide sequence. In some embodiments, the encoded recombinant methionine gamma lyase polypeptide includes 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions.

In some embodiments, the polynucleotides are capable of hybridizing under highly stringent conditions to a reference polynucleotide sequence encoding a recombinant methionine gamma lyase. In some embodiments, the reference sequence is selected from SEQ ID NOS: 1, 93, 247, 351, 477, 831, 915, 1171, 1231, 1345, and/or 1487, or a complement thereof, or a polynucleotide sequence encoding any of the variant methionine gamma lyase polypeptides provided herein. In some embodiments, the polynucleotide capable of hybridizing under highly stringent conditions encodes a methionine gamma lyase polypeptide comprising a polypeptide sequence that has one or more residue differences as compared to SEQ ID NO: 2, 94, 248, 352, 478, 832, 916, 1172, 1232, 1346, and/or 1488, at residue positions selected from any positions as set forth in Table 3-1, 3-2, 3-3, 3-4, 3-5, 3-6, 3-7, 3-8, 3-9, 3-10, 3-11, and/or 3-12. In some embodiments, the engineered polynucleotide is selected from those provided in Table 3-1, 3-2, 3-3, 3-4, 3-5, 3-6, 3-7, 3-8, 3-9, 3-10, 3-11, and/or 3-12, or comprises a polynucleotide having at least 70%, 75%, 80%, 81%, 82%, 83%, 84%, 85%, 86%, 87%, 88%, 89%, 90%, 91%, 92%, 93%, 94%, 95% 96%, 97%, 98%, 99% or more sequence identity to a reference sequence selected from 1, 93, 247, 351, 477, 831, 915, 1171, 1231, 1345, and/or 1487. In some additional embodiments, the polynucleotide hybridizing under highly stringent conditions comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide reference sequence provided in Table 3-1, 3-2, 3-3, 3-4, 3-5, 3-6, 3-7, 3-8, 3-9, 3-10, 3-11, and/or 3-12, and/or SEQ ID NO: 1, 93, 247, 351, 477, 831, 915, 1171, 1231, 1345, and/or 1487.

In some embodiments, an isolated polynucleotide encoding any of the engineered methionine gamma lyase polypeptides provided herein is manipulated in a variety of ways to provide for expression of the gene and production of the polypeptide. In some embodiments, the polynucleotides encoding the polypeptides are provided as expression vectors, in which one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase, *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]). Exemplary promoters for use in mammalian cells include, but are not limited to those from cytomegalovirus (CMV), Simian vacuolating virus 40 (SV40), from *Homo sapiens* phosphoglycerate kinase, beta actin, elongation factor-1a or glyceraldehyde-3-phosphate dehydrogenase, or from *Gallus* β-actin.

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra). Exemplary terminators for mammalian cells include, but are not limited to those from cytomegalovirus (CMV), Simian vacuolating virus 40 (SV40), or from *Homo sapiens* growth hormone.

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence.

Any signal peptide coding region that directs the expressed polypeptide into the secretory pathway of a host cell of choice finds use for expression of the engineered methionine gamma lyase polypeptides provided herein. Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase. Useful signal peptides for mammalian host cells include but are not limited to those from the genes for immunoglobulin gamma (IgG).

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide.

In another aspect, the present invention also provides a recombinant expression vector comprising a polynucleotide encoding an engineered methionine gamma lyase polypeptide, and one or more expression regulating regions such as a promoter and a terminator, a replication origin, etc., depending on the type of hosts into which they are to be introduced. in some embodiments, the various nucleic acid and control sequences described above are joined together to produce a recombinant expression vector which includes one or more convenient restriction sites to allow for insertion or substitution of the nucleic acid sequence encoding the variant methionine gamma lyase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant methionine gamma lyase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells.

A "selectable marker" is a gene the product of which provides for biocide or viral resistance, resistance to heavy metals, prototrophy to auxotrophs, and the like. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered methionine gamma lyase polypeptide of the present application, the polynucleotide being operatively linked to one or more control sequences for expression of the engineered methionine gamma lyase enzyme(s) in the host cell.

Host cells for use in expressing the polypeptides encoded by the expression vectors of the present invention are well known in the art and include but are not limited to, fungal cells, such as yeast cells (e.g., *Saccharomyces cerevisiae* and *Pichia pastoris* [e.g., ATCC Accession No. 201178]); insect cells (e.g., *Drosophila* S2 and *Spodoptera* Sf9 cells), plant cells, animal cells (e.g., CHO, COS, and BHK), and human cells (e.g., HEK293T, human fibroblast, THP-1, Jurkat and Bowes melanoma cell lines).

Accordingly, in another aspect, the present invention provides methods for producing the engineered methionine gamma lyase polypeptides, where the methods comprise culturing a host cell capable of expressing a polynucleotide encoding the engineered methionine gamma lyase polypeptide under conditions suitable for expression of the polypeptide. In some embodiments, the methods further comprise the steps of isolating and/or purifying the methionine gamma lyase polypeptides, as described herein.

Appropriate culture media and growth conditions for the above-described host cells are well known in the art. Polynucleotides for expression of the methionine gamma lyase may be introduced into cells by various methods known in the art. Techniques include, among others, electroporation, biolistic particle bombardment, liposome mediated transfection, calcium chloride transfection, and protoplast fusion.

The engineered methionine gamma lyase with the properties disclosed herein can be obtained by subjecting the polynucleotide encoding the naturally occurring or engineered methionine gamma lyase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837, 458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 8,849,575, 9,593,326, 9,665,694, 9,684,771, 9,864,833, 9,996,661, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme variants obtained following mutagenesis treatment are screened by subjecting the enzyme variants to a defined temperature (or other assay conditions) and measuring the amount of enzyme activity remaining after heat treatments or other assay conditions. DNA containing the polynucleotide encoding the methionine gamma lyase polypeptide is then isolated from the host cell, sequenced to identify the nucleotide sequence changes (if any), and used to express the enzyme in a different or the same host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors.

Accordingly, in some embodiments, a method for preparing the engineered methionine gamma lyase polypeptide can comprise: (a) synthesizing a polynucleotide encoding a polypeptide comprising a polypeptide sequence selected from the polypeptide sequence of any variant provided in Table 3-1, 3-2, 3-3, 3-4, 3-5, 3-6, 3-7, 3-8, 3-9, 3-10, 3-11, and/or 3-12, as well as SEQ ID NOS: 2, 94, 248, 352, 478, 832, 916, 1172, 1232, 1346, and/or 1488, and (b) expressing the methionine gamma lyase polypeptide encoded by the polynucleotide. In some embodiments of the method, the polypeptide sequence encoded by the polynucleotide can optionally have one or several (e.g., up to 3, 4, 5, or up to 10) amino acid residue deletions, insertions and/or substitutions. In some embodiments, the polypeptide sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the polypeptide sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the polypeptide sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered methionine gamma lyase polypeptide can be assessed for any desired improved property (e.g., activity, selectivity, stability, acid tolerance, protease sensitivity, etc.), using any suitable assay known in the art, including but not limited to the assays and conditions described herein.

In some embodiments, any of the engineered methionine gamma lyase polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the methionine gamma lyase polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant methionine gamma lyase enzymes. In some embodiments utilizing affinity chromatography purification, any antibody which specifically binds the variant methionine gamma lyase polypeptide finds use.

In some embodiments utilizing affinity chromatography purification, proteins that bind to the glycans covalently attached to methionine gamma lyase find use. In still other embodiments utilizing affinity-chromatography purifications, any small molecule that binds to the methionine gamma lyase active site finds use. For the production of antibodies, various host animals, including but not limited to rabbits, mice, rats, etc., are immunized by injection with a polypeptide (e.g., a methionine gamma lyase variant), or a fragment thereof. In some embodiments, the methionine gamma lyase polypeptide or fragment is attached to a suitable carrier, such as BSA, by means of a side chain functional group or linkers attached to a side chain functional group.

In some embodiments, the engineered methionine gamma lyase polypeptide is produced in a host cell by a method comprising culturing a host cell (e.g., *S. cerevisiae, Daucus carota, Nicotiana tabacum, H. sapiens* (e.g., HEK293T), or *Criceiulus griseus* (e.g., CHO)) comprising a polynucleotide sequence encoding an engineered methionine gamma lyase polypeptide as described herein under conditions conducive to the production of the engineered methionine gamma lyase polypeptide and recovering the engineered methionine gamma lyase polypeptide from the cells and/or culture medium.

In some embodiments, the invention encompasses a method of producing an engineered methionine gamma lyase polypeptide comprising culturing a recombinant eukaryotic cell comprising a polynucleotide sequence encoding an engineered methionine gamma lyase polypeptide having at least 80%, 81%, 82%, 83%, 84%, 85%, 86%, 87%, 88%, 89%, 90%, 95%, 96%, 97%, 98%, 99%, or 100% sequence identity to a reference sequence (e.g., SEQ ID NO: 2, 94, 248, 352, 478, 832, 916, 1172, 1232, 1346, and/or 1488), and one or more amino acid residue differences as compared to SEQ ID NO: 2, 94, 248, 352, 478, 832, 916, 1172, 1232, 1346, and/or 1488, selected from those provided in Table 3-1, 3-2, 3-3, 3-4, 3-5, 3-6, 3-7, 3-8, 3-9, 3-10, 3-11, and/or 3-12, and/or combinations thereof when optimally aligned with the polypeptide sequence of SEQ ID NO: 2, 94, 248, 352, 478, 832, 916, 1172, 1232, 1346, and/or 1488, under suitable culture conditions to allow the production of the engineered methionine gamma lyase polypeptide and optionally recovering the engineered methionine gamma lyase polypeptide from the culture and/or cultured bacterial cells.

In some embodiments, once the engineered polypeptides are recovered from the recombinant host cells or cell culture medium, they are further purified by any suitable method(s) known in the art. In some additional embodiments, the purified methionine gamma lyase polypeptides are combined with other ingredients and compounds to provide compositions and formulations comprising the engineered methionine gamma lyase polypeptide as appropriate for different applications and uses (e.g., pharmaceutical compositions). In some additional embodiments, the purified v polypeptides, or the formulated methionine gamma lyase polypeptides are lyophilized.

Compositions and Uses of the Engineered Methionine Gamma Lyase

The present invention provides various compositions and formats, including but not limited to those described below. In some embodiments, the present invention provides engineered methionine gamma lyase polypeptides suitable for use in pharmaceutical and other compositions, such as dietary/nutritional supplements.

Depending on the mode of administration, these compositions comprising a therapeutically effective amount of an engineered methionine gamma lyase according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered methionine gamma lyase polypeptides are formulated for use in pharmaceutical compositions. Any suitable format for use in delivering the engineered methionine gamma lyase polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, solutions, suspensions (including but not limited to oil-based suspensions, oil-in water emulsions, etc.), slurries, syrups, controlled release formulations, suppositories, etc. In some embodiments, the engineered methionine gamma lyase polypeptides are provided in a format suitable for injection or infusion (i.e., in an injectable formulation). In some embodiments, the engineered methionine gamma lyase polypeptides are provided in biocompatible matrices such as sol-gels, including silica-based (e.g., oxysilane) sol-gels. In some embodiments, the engineered methionine gamma lyase polypeptides are encapsulated. In some alternative embodiments, the engineered methionine gamma lyase polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered methionine gamma lyase polypeptides be administered by any suitable means known in the art, including but not limited to parenteral, oral, topical, transdermal, intranasal, intraocular, intrathecal, via implants, etc.

In some embodiments, the engineered methionine gamma lyase polypeptides are chemically modified by glycosylation, chemical crosslinking reagents, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, and 7,560,263; US Pat. Appln. Publ. Nos. 2013/0039898, 2012/0177722, etc.). Indeed, it is not intended that the present invention be limited to any particular delivery method and/or mechanism.

In some additional embodiments, the engineered methionine gamma lyase polypeptides are provided in formulations comprising matrix-stabilized enzyme crystals. In some embodiments, the formulation comprises a cross-linked crystalline engineered methionine gamma lyase enzyme and a polymer with a reactive moiety that adheres to the enzyme crystals. The present invention also provides engineered methionine gamma lyase polypeptides in polymers.

In some embodiments, compositions comprising the engineered methionine gamma lyase polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.).

In some embodiments, the recombinant methionine gamma lyase polypeptides described herein are used to treat, and/or ameliorate homocystinuria or its associated symptoms. In some embodiments, the recombinant methionine gamma lyase polypeptides described herein are used to reduce levels of plasma or serum methionine, homocysteine, and/or homocysteine-cysteine complex in a subject. The dosage of engineered methionine gamma lyase polypeptide(s) administered depends upon the condition or disease, the general condition of the subject, and other factors known to those in the art. In some embodiments, the compositions comprising the recombinant methionine gamma lyase polypeptides are intended for single or multiple administrations.

In some embodiments, the amount of recombinant methionine gamma lyase polypeptide(s) in the composition(s) administered to a human with homocystinuria disease is sufficient to effectively treat, and/or ameliorate disease (e.g., homocystinuria disease). In some embodiments, the engineered methionine gamma lyase polypeptides are administered in combination with other pharmaceutical and/or dietary compositions. In some embodiments, a method of treating homocystinuria in a subject comprises administering to a subject with homocystinuria an effective amount of a recombinant methionine gamma lyase polypeptide to treat, and/or ameliorate homocystinuria or its associated symptoms. In some embodiments, a subject with homocystinuria is administered an effective amount of a recombinant methionine gamma lyase polypeptide to reduce levels of plasma or serum methionine, homocysteine, and/or homocysteine-cysteine complex.

In some embodiments, the recombinant methionine gamma lyase is administered in an amount effective to reduce plasma or serum methionine and/or homocysteine levels by 5% or more, 10% or more, 15% or more, 20% or more, 25% or more, 30% or more, 40% or more, and/or 50% or more compared to baseline levels in untreated subjects with the disease or disorder. In some embodiments, the symptoms of homocystinuria are ameliorated in a subject upon the administration of the composition comprising at least one recombinant methionine gamma lyase to the subject.

In some embodiments, the subject is able to eat a diet that is less restricted in its lipid content than diets required by subjects exhibiting the symptoms of homocystinuria. In some embodiments, the engineered methionine gamma lyase polypeptide is suitable for use to improve dietary fat absorption and in decreasing the dietary lipids. In some embodiments, the present invention provides engineered methionine gamma lyase polypeptides suitable for use in decreasing the concentration of glycolipids in fluids such as blood, cerebrospinal fluid, etc.

In some embodiments, the recombinant methionine gamma lyase polypeptide is administered at a dose of about 1 mg/kg to about 500 mg/kg. In some embodiments, the recombinant methionine gamma lyase polypeptide is administered at a dose of about 1 mg/kg to about 400 mg/kg or about 1 mg/kg to about 200 mg/kg. In some embodiments, the recombinant methionine gamma lyase polypeptide is administered at a dose of about 2 mg/kg to about 300 mg/kg, or about 5 mg/kg to about 200 mg/kg. In some embodiments, the recombinant methionine gamma lyase polypeptide is administered at a dose of about 1 mg/kg, about 5 mg/kg, about 10 mg/kg, about 20 mg/kg, about 30 mg/kg, about 40 mg/kg, about 50 mg/kg, about 60 mg/kg, about 70 mg/kg, about 80 mg/kg, about 90 mg/kg, about 100 mg/kg, about 120 mg/kg, about 140 mg/kg, about 160 mg/kg, about 180 mg/kg, about 200 mg/kg, about 250 mg/kg, about 300 mg/kg, about 350 mg/kg, about 400 mg/kg, about 450 mg/kg, or about 500 mg/kg.

In some embodiments, the recombinant methionine gamma lyase polypeptide or composition thereof is administered immediately before, concurrently with, or immediately following ingestion of a protein meal containing methionine.

In some embodiments, the subject who is treated is able to eat a diet that is less restricted in its in methionine content compared to diets required by subjects who do not have the disease. In some additional embodiments, the subject who is treated is able to eat a diet less restricted in protein content compared to diets required by subjects who do not have the disease. In some embodiments, the subject is an infant, child, young adult, or adult.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar, uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); *E. coli* W3110 (commonly used laboratory *E. coli* strain, available from the *Coli* Genetic Stock Center [CGSC], New Haven, CT); HCU (homocystinuria); MGL and mgl (methionine gamma lyase); HPLC (high pressure liquid chromatography); ms (mass spectrometry or mass spectroscopy); SDS-PAGE (sodium dodecyl sulfate polyacrylamide gel electrophoresis); PLP (pyridoxal phosphate); NaOAc (sodium acetate); MBTH (3-Methyl-2-benzothiazolinone hydrazone); PES (polyethersulfone); ACN (acetonitrile); IPA (isopropyl alcohol); IPTG (isopropyl β-D-1-thiogalactopyranoside); PMBS (polymyxin B sulfate); NADPH (nicotinamide adenine dinucleotide phosphate); LB (Luria broth); MeOH (methanol); TAG (triolein); DAG (diolein); MAG (monoolein); OA (oleic acid); FIOPC (fold improvements over positive control); HTP (high throughput); CAV (cell accelerator voltage; collision cell accelerator voltage); CE (collision energy); RF (radio frequency); SOP (standard operating procedure); Covance (Covance, Inc., Princeton, NJ); Athens Research (Athens Research Technology, Athens, GA); ProSpec (ProSpec Tany Technogene, East Brunswick, NJ); Sigma-Aldrich (Sigma-Aldrich, St. Louis, MO); PMI Nutrition (PMI Nutrition International, LLC, St. Louis, MO); Millipore (Millipore, Corp., Billerica MA); Difco (Difco Laboratories, BD Diagnostic Systems, Detroit, MI); Molecular Devices (Molecular Devices, LLC, Sunnyvale, CA); Kuhner (Adolf Kuhner, AG, Basel, Switzerland); Applied Biosystems (Applied Biosystems, part of Life Technologies, Corp., Grand Island, NY), Agilent (Agilent Technologies, Inc., Santa Clara, CA); RAPIDFIRE® MS (RAPIDFIRE® mass spectrometer, Agilent); Thermo Scientific (part of ThermoFisher Scientific, Waltham, MA); ThermoFisher Scientific (Thermo Fisher Scientific, Waltham, MA); and Corning (Corning, Inc., Palo Alto, CA).

Example 1

Bacterial Methionine Gamma Lyase (MGL) Gene Acquisition and Construction of Expression Vectors

*Pseudomonas entomophila* methionine gamma lyase (PeMGL; SEQ ID NO: 2) was codon optimized for expression in *E. coli* and cloned into the *E. coli* expression vector pCK110900 vector system (See e.g., U.S. Pat. No. 7,629,157, hereby incorporated by reference) or pJV110900 vector system (See e.g., U.S. Pat. No. 10,184,117, hereby incorporated by reference). However, it is not intended that the present invention be limited to any specific vectors. In addition, in some embodiments, expression vectors lacking antimicrobial resistance markers find use. The plasmid construct was transformed into an *E. coli* strain derived from W3110. Directed evolution techniques generally known by those skilled in the art were used to generate libraries of gene variants from this plasmid construct (See e.g., U.S. Pat. No. 8,383,346, and WO2010/144103) as well as its derivatives.

Example 2

High-Throughput (HTP) Growth of MGL Variants and Screening Conditions High-Throughput (HTP) Growth of *P. entomophila* Methionine Gamma Lyase (PeMGL) Variants Transformed *E. coli* cells were selected by plating onto LB agar plates containing 1% glucose with selection compound (e.g., chloramphenicol for constructs in pCK110900 vector, triclosan for constructs in pJV110900 vector). After overnight incubation at 37° C., colonies were placed into the wells of 96-well shallow flat bottom plates (NUNC™, Thermo-Scientific) filled with 180 µl/well LB supplemented with 1% glucose and selection compound. The cultures were allowed to grow overnight for 18-20 hours in a Khuner shaker (200 rpm, 30° C., and 85% relative humidity).

Overnight growth samples (20 µL) were transferred into COSTAR® 96-well deep plates filled with 380 µL of Terrific Broth supplemented with a selection compound. The plates were incubated for 135 minutes in a shaker (250 rpm, 30° C., and 85% relative humidity; Kuhner). The cells were then induced with 40 µL of 10 mM IPTG in sterile water and incubated overnight for 20-24 hours in a Khuner shaker (250 rpm, 30° C., and 85% relative humidity). The cells were pelleted (4000 rpm×20 min), the supernatants were discarded, and the cells were frozen at −80° C. prior to analysis.

Lysis of HTP Pellets

First, 400 µL of lysis buffer (50 mM potassium phosphate pH 7, 1 mg/ml lysozyme, and 0.5 mg/ml polymyxin B sulfate) were added to the cell pellets. The mixture was agitated for 2 h at room temperature, and centrifuged (4000 rpm×20 min) prior to use of the clarified lysates in the various HTP assays described herein. Analysis of these lysates by SDS-PAGE revealed the presence of an overexpressed protein at an apparent MW of ~45 kDa, consistent with the expected MW of PeMGL.

Analysis of Clarified Lysates

The PeMGL variant activity was determined by measuring the consumption of methionine in a 30 minute reaction by quantifying the amount of α-ketobutyrate produced, via an azine derivative of MBTH reagent. In this assay, the MGL reaction produces α-ketobutyrate, which reacts with the MBTH used to quench the reaction, to form an azine derivative of MBTH, which is then detected by spectrophotometry (absorbance at 320 nm). For this assay, 5.5 mM methionine solution was prepared in 50 mM potassium phosphate buffer containing 0.005 mM PLP (i.e., a co-factor for MGL); 90 µL of the methionine solution was mixed with 10 µL of lysate and added to the wells of a polypropylene 96-well flat bottom microtiter plate (NUNC™; Thermo-Scientific, #260836) and incubated at 37° C. for 30 min with agitation at 250 rpm. The reactions were quenched with 150 µL 133 mM NaOAc pH 5 with 0.03% MBTH in NUNC™ 96-well flat-bottom plates, incubated at 50° C. for 30 minutes with agitation at 250 rpm. Absorbance was measured at 320 nm using a SPECTRAMAX® plate reader (Molecular Devices) to quantify the amount of α-ketobutyrate produced (via azine derivative). The results are provided in Tables below.

To determine activity of PeMGL variants in presence of low methionine concentrations, 0.25 mM methionine solution was prepared in 50 mM potassium phosphate buffer containing 0.005 mM PLP; the reaction was performed as described above. The results are provided in Tables below.

HTP Analysis of Clarified Lysates Pretreated with Heat Challenge

The activities of PeMGL variants were determined after incubation at 61° C. First, 100 µL of clarified lysate were added to the wells of a 96-well BioRad Hard-Shell PCR thin wall microtiter plate (#hsp9601; BioRad). The plates were sealed and incubated at 61° C. in a thermocycler for 90 minutes prior to analysis. Variant activity was determined by measuring the formation of α-ketobutyrate produced, via azine derivative. For this assay, 90 µL of 50 mmM potassium phosphate pH 7 with 5.5 mM methionine and 0.005 mM PLP were mixed with 10 uL of heat-incubated lysate and added to the wells of a polypropylene 96-well flat bottom microtiter plate (NUNC™, Thermo-Scientific #260836) and incubated at 37° C. for 30 min with agitation at 250 rpm. The reactions were quenched with 150 µL 133 mM NaOAc pH 5 with 0.03% MBTH in 96-well NUNC™ flat-bottom plate, incubated at 50° C. for 30 minutes with agitation at 250 rpm. Absorbance was measured at 320 nm using a SPECTRAMAX® plate reader to quantify the amount of α-ketobutyrate produced (via azine derivative). The results are provided in the Tables below.

HTP Analysis of Clarified Lysates Pretreated with Low pH

The activities of PeMGL variants were determined after incubation at pH 5.2, to simulate the environment in the stomach. First, 100 µL of lysate was pre-incubated with McIlvaine buffer, pH 5.2 in a 96-well round bottom plate. The plates were sealed and incubated for 90 minutes at 37° C. with agitation at 250 rpm. After the preincubation period, samples were centrifuged, and 10 µL of the supernatant were added to 90 µL of assay mix consisting of 5 mM methionine and 0.005 mM PLP dissolved in 50 mM sodium phosphate buffer, pH 7, in a 96-well COSTAR® round-bottom plate (COSTAR® Corning #3798). The reactions were incubated at 37° C., 250 rpm for 30 minutes. The reactions were quenched by transferring 30 µL of the reaction into 150 µL of 0.5 M NaOAc pH 5 with 0.03% MBTH in NUNC™ 96-well flat-bottom plate, and incubation at 50° C. for 30 minutes, 250 rpm. MGL enzyme activity was assessed by quantifying α-ketobutyrate produced (via azine derivative) using a SPECTRAMAX® plate reader (absorbance at 320 nm). The results are provided in the Tables below.

HTP Analysis of Clarified Lysates with Combined Heat Challenge and Low Amount of Substrate The activities of PeMGL variants were determined after incubation at 65° C. with a low amount of methionine substrate. First, 100 µL of clarified lysate were added to the wells of a 96-well BioRad Hard-Shell PCR thin wall microtiter plate (#hsp9601; BioRad). The plates were sealed and incubated at 65° C. in a thermocycler for 90 minutes. Next, 0.25 mM methionine solution were prepared in 50 mM potassium phosphate buffer containing 0.005 mM PLP; 90 µL of the methionine solution was mixed with 10 µL of lysate and added to the wells of a polypropylene 96-well flat bottom microtiter plate (NUNC™, Thermo-Scientific #260836) and incubated at 37° C. for 30 min with agitation at 250 rpm. The reactions were quenched with 150 µL 133 mM NaOAc pH 5, with 0.03% MBTH in 96-well NUNC™ flat-bottom plate, incubated at 50° C. for 30 minutes with agitation at 250 rpm. Absorbance was measured at 320 nm using a SPECTRAMAX® plate reader to quantify the amount of α-ketobutyrate produced (via azine derivative). The results are provided in Tables below.

HTP Analysis of Clarified Lysates with Two-Step Heat and Low pH Challenge

The activities of PeMGL variants were determined after two-step heat and low pH challenge. First, 100 µL of clarified lysate were added to the wells of a 96-well BioRad Hard-Shell PCR thin wall microtiter plate (#hsp9601; Bio- Rad). The plates were sealed and incubated at 65° C. in a thermocycler for 90 minutes prior to low pH challenge. Next, PeMGL variants were incubated with McIlvaine buffer, pH 5.2, to simulate the environment of the stomach. Then, 40 µL of McIlvaine buffer, pH 5.2 and 40 µL of heat-treated lysate were added to the wells of a 96-well round bottom microtiter plate. The plates were sealed and incubated for 90 minutes at 37° C. with agitation at 250 rpm. After preincubation period, 10 µL of each sample were added to 90 µL of assay mix consisting of 5 mM methionine with 0.005 mM PLP dissolved in 50 mM sodium phosphate buffer, pH 7, in a 96-well COSTAR® round-bottom plate. The reactions were incubated for 30 minutes at 37° C., 250 rpm. The reactions were quenched by transferring 30 µL of the reaction into 150 µL of 133 mM NaOAc pH 5 with 0.03% MBTH in 96-well NUNC™ flat-bottom plate, and then incubated at 50° C. for 30 minutes with 250 rpm agitation. MGL enzyme activity was assessed by quantifying α-ketobutyrate produced (via azine derivative) using a SPECTRAMAX® microplate reader (absorbance at 320 nm). The results are provided in the Tables below.

HTP Analysis of Clarified Lysates Pretreated with Protease

The activities of PeMGL variants were determined after incubation with chymotrypsin and trypsin, to simulate the environment of the lower intestine. First, 125 µL of lysate were aliquoted into a 96-well round bottom plate. These samples were then mixed with either 125 µL of 50 mM potassium phosphate buffer pH 7, or 125 µL of a protease solution consisting of 3 g/L porcine trypsin and 3 g/L bovine chymotrypsin dissolved in 50 mM sodium phosphate buffer, pH 7, and incubated for 0, 0.5, 1, or 2 hours at 37° C. with agitation at 250 rpm. After preincubation period, 10 µL of each sample were added to 90 µL of assay mix consisting of 5 mM methionine with 0.005 mM PLP dissolved in 50 mM sodium phosphate buffer, pH 7, in a 96-well COSTAR® round-bottom plate. The reactions were incubated for 30 minutes at 37° C., 250 rpm. The reactions were quenched by transferring 30 µL of the reaction into 150 µL of 133 mM NaOAc pH 5 with 0.03% MBTH in 96-well NUNC™ flat-bottom plate, and then incubated at 50° C. for 30 minutes with 250 rpm agitation. MGL enzyme activity was assessed by quantifying α-ketobutyrate produced (via azine derivative) using a SPECTRAMAX® microplate reader (absorbance at 320 nm). The results are provided in the Tables below.

HTP Analysis of Clarified Lysates with Two-step Heat and Protease Challenge

The activities of PeMGL variants were determined after pre-incubation at 65° C. followed by incubation with trypsin and chymotrypsin. First, 100 µL of clarified lysate were added to the wells of a 96-well BioRad Hard-Shell PCR thin wall microtiter plate (#hsp9601; BioRad). The plates were sealed and incubated at 65° C. in a thermocycler for 90 minutes prior to incubation with protease. Next, 125 µL of heat-treated lysate were aliquoted into a 96-well round bottom plate. These samples were then mixed with either 125 µL of 50 mM potassium phosphate buffer pH 7, or 125 µL of a protease solution consisting of 3 g/L porcine trypsin and 3 g/L bovine chymotrypsin dissolved in 50 mM sodium phosphate buffer, pH 7, and incubated for 90 minutes at 37° C. with agitation at 250 rpm. After incubation period, 10 µL of each sample were added to 90 µL of assay mix consisting of 5 mM methionine with 0.005 mM PLP dissolved in 50 mM sodium phosphate buffer, pH 7, in a 96-well COSTAE® round-bottom plate. The reactions were incubated for 30 minutes at 37° C., 250 rpm. The reactions were quenched by transferring 30 µL of the reaction into 150 µL of 133 mM NaOAc pH 5 with 0.03% MBTH in 96-well NUNC™ flat-bottom plate, and then incubated at 50° C. for 30 minutes with 250 rpm agitation. MGL enzyme activity was assessed by quantifying α-ketobutyrate produced (via azine derivative) using a SPECTRAMAX® microplate reader (absorbance at 320 nm). The results are provided in the Tables below.

HTP Analysis of Clarified Lysates with Multistep Gastrointestinal Challenge

The activities of PeMGL variants were determined after multistep heat, pH and protease challenge. First, 100 µL of clarified lysate were added to the wells of a 96-well BioRad Hard-Shell PCR thin wall microtiter plate (#hsp9601; BioRad). The plates were sealed and incubated at 65° C. in a thermocycler for 1 h prior to low pH challenge. Next, PeMGL variants were incubated with McIlvaine buffer, pH 4, to simulate the environment of the stomach. Then, 40 µL of McIlvaine buffer, pH 4 and 40 µL of heat-treated lysate were added to the wells of a 96-well round bottom microtiter plate. The plates were sealed and incubated for 60 minutes at 37° C. with agitation at 250 rpm. Next, 40 µL of the pH-challenged lysate were mixed with 40 µL of a protease solution consisting of 0.3 g/L porcine trypsin and 0.3 g/L bovine chymotrypsin dissolved in 50 mM sodium phosphate buffer, pH 7, and incubated for 90 minutes at 37° C. with agitation at 250 rpm. After preincubation period, 10 µL of each sample were added to 90 µL of assay mix consisting of 5 mM methionine with 0.005 mM PLP dissolved in 50 mM sodium phosphate buffer, pH 7, in a 96-well COSTAR® round-bottom plate. The reactions were incubated for 30 minutes at 37° C., 250 rpm. The reactions were quenched by transferring 30 µL of the reaction into 150 µL of 133 mM NaOAc pH 5 with 0.03% MBTH in 96-well NUNC™ flat-bottom plate, and then incubated at 50° C. for 30 minutes with 250 rpm agitation. MGL enzyme activity was assessed by quantifying α-ketobutyrate produced (via azine derivative) using SPECTRAMAX® microplate reader (absorbance at 320 nm). The results are provided in the Tables below.

Example 3

Screening Results for MGL Variants

The variants generated from homologs diversity and saturation mutagenesis were screened under several different conditions as described in Example 2. The results (relative to SEQ ID NO: 2) are provided in Table 3-1. In this Table, the amino acid differences are indicated relative to SEQ ID NO: 2.

TABLE 3-1

Methionine Gamma Lyase Activity (Relative to SEQ ID NO: 2)[1]

| SEQ ID NO: (nt/aa) | Amino Acid Differences (Relative to SEQ ID NO: 2) | FIOP Unchallenged | FIOP Low Met | FIOP 61° C. | FIOP pH 5.2 | FIOP Protease |
|---|---|---|---|---|---|---|
| 1/2 | | + | + | + | + | |
| 3/4 | L69W/L140T/A145G/I322Q/A348V | | | +++ | ++++ | |
| 5/6 | L69W/Y189L/N290A/A344T/H366Q | ++ | ++ | +++ | ++ | |
| 7/8 | A145G/Y189L | ++ | ++ | +++ | | |
| 9/10 | A145G/N290A | | +++ | | ++++ | |
| 11/12 | L69I/Q165R/A344C/H366Q | ++ | ++ | +++ | +++ | |
| 13/14 | L69I/N138C/A145G/Y189L/E199T/N290A/A344T | +++ | ++ | +++ | + | |
| 15/16 | Y189L | +++ | ++ | +++ | | |
| 17/18 | L69W/N138C/Y189L/S336H/A344C | +++ | ++ | +++ | ++ | |
| 19/20 | A145G/Y189L/E199T/A263P/S296N/S336H/A344T/H366Q | +++ | ++ | | | |
| 21/22 | L69W/Y189L/I322A | +++ | ++ | +++ | ++ | |
| 23/24 | L69I/N138C/Q165R/Y189L/N290A/S296N/I322A/S336H/A344C/A398P | ++ | + | +++ | ++ | |
| 25/26 | N138C/Y189L/A263P/I322Q/H366Q | +++ | ++ | + | + | |
| 27/28 | Q165R/Y189L/E199T/I322Q/H366Q | +++ | ++ | | | |
| 29/30 | L69I/A145G/Y189L/H366Q/A398P | | | +++ | | |
| 31/32 | L140T/Q165R/S296N/I322Q/S336H | +++ | ++ | | | |
| 33/34 | L69I | ++ | ++ | +++ | +++ | |
| 35/36 | L69W/N138C/S336H/H366Q | +++ | ++ | +++ | | |
| 37/38 | L69W/A145G/Y189L/E199T/N290A | +++ | ++ | +++ | | |
| 39/40 | L69W/Q165R/Y189L/E199T/A263P/S336H/H366Q | +++ | ++ | | | |
| 41/42 | A145G/A263P/N290A/A344T/A398P | ++++ | | | | |
| 43/44 | A145G/Y189L/E199T/I322A/A344T/A398P | +++ | ++ | ++ | ++ | |
| 45/46 | L69I/A145G/I322Q/A344C | ++ | ++ | ++ | +++ | |
| 47/48 | L69I/A145G/E199T/S336H/A344T | +++ | +++ | ++ | | |
| 49/50 | L140T/A145G/Y189L/I322A/A344C/H366Q | +++ | +++ | +++ | +++ | |
| 51/52 | L140T/A145G/Y189L | +++ | ++ | +++ | | |
| 53/54 | L69I/Q165R/Y189L/A263P/I322Q/S336H | +++ | ++ | | | |
| 55/56 | Y189L/N290A/I322Q/S336H/H366Q | +++ | +++ | ++ | | |
| 57/58 | Y189L/N290A/I322Q/A344T | +++ | +++ | +++ | ++ | |
| 59/60 | L69W/N138C/Y189L/E199T/H366Q | +++ | | ++ | | |
| 61/62 | L69I/N138C/L140T/Y189L/E199T/S336H | +++ | ++ | + | | |
| 63/64 | L69W/Q165R/S296N/A398P | +++ | + | | | |
| 65/66 | Y189L/N290A/H366Q | ++ | ++ | +++ | | |
| 67/68 | Q165R/I322S/S336H | ++ | +++ | | | |
| 69/70 | L69I/Q165R/I322Q/A344C/H366Q | | +++ | ++ | ++ | |
| 71/72 | L69I/A145G/Q165R/I322A | ++ | +++ | ++ | ++ | |
| 73/74 | Y189L/I322A/A344C | +++ | +++ | | +++ | |
| 75/76 | L69W/N138C/E199T/A263P/I322A/A344C/H366Q | ++ | +++ | | | |
| 77/78 | L69I/Q165R/I322Q | ++ | +++ | + | | |
| 79/80 | L69I/Q165R/A263P/N290A/S336H | ++ | +++ | | | |
| 81/82 | L69I/A145G/A344C | ++ | ++ | +++ | +++ | |
| 83/84 | Y189L/I322A | ++ | +++ | ++ | | |
| 85/86 | L69I/I322A/A344C/A398P | ++ | ++ | ++ | +++ | |
| 87/88 | L69W/L140T/Q165R/Y189L/I322A/H366Q | ++ | +++ | +++ | | |

TABLE 3-1-continued

Methionine Gamma Lyase Activity (Relative to SEQ ID NO: 2)[1]

| SEQ ID NO: (nt/aa) | Amino Acid Differences (Relative to SEQ ID NO: 2) | FIOP Unchallenged | FIOP Low Met | FIOP 61° C. | FIOP pH 5.2 | FIOP Protease |
|---|---|---|---|---|---|---|
| 89/90 | L69W | | ++ | +++ | | |
| 91/92 | Q165R/S336H/A344T | + | +++ | | | |
| 93/94 | L69I/N290A/A344T | + | +++ | +++ | +++ | |
| 95/96 | L69I/A145G/Q165R/S296N/ S336H/A344T/H366Q | ++ | ++ | +++ | | |
| 97/98 | Y38F/Q141E/A173V/L288K/ R308A/H366E | + | ++ | +++ | + | |
| 99/100 | N6S/G25E/Y38F/Q141E/A173V/ Q275A/H366E/K395D | | + | + | +++ | |
| 101/102 | N6S/Y38F/G55P/Q141E/D180G/ L288K/Q362E/H366E | +++ | + | +++ | ++ | |
| 103/104 | N6S/Y38F/N138T/Q141E/A173V/ L288K/H366E | ++ | + | +++ | +++ | |
| 105/106 | N6S/Y38F/G55P/N138S/Q141E/ L288K/R308A | ++ | + | ++ | +++ | |
| 107/108 | N6S/Y38F/G55P/Q141E/D180G/ Q275A/Q362E | ++ | + | +++ | ++ | |
| 109/110 | N6S/Y38F/G55P/N138T | | + | + | +++ | |
| 111/112 | N6S/G55P/N138T/A173V/H366E | ++ | + | + | +++ | |
| 113/114 | N6S/G25E/G55P | | + | | +++ | |
| 115/116 | Y38F/A173V | + | + | ++ | +++ | |
| 117/118 | G25E/Y38F/G55P/Q275A/L288K | +++ | ++ | + | +++ | |
| 119/120 | Y38F/G55P/Q362E | ++ | ++ | ++ | +++ | |
| 121/122 | Y38F/Q141E/R308A/Q362E/ H366E | ++ | ++ | ++ | +++ | |
| 123/124 | N6S/D180G/Q362E/H366E | | +++ | + | ++ | |
| 125/126 | N6S/G55P/Q283H/Q362E/ H366E | | +++ | + | ++ | |
| 127/128 | N6S/Y38F/Q141E/L288K/ H366E | ++ | + | +++ | +++ | |
| 129/130 | N6S/Y38F/G55P/Q275A/L288K/ R308A | ++ | + | ++ | +++ | |
| 131/132 | Y38F/G55P/D180G/Q362E/ H366E | ++ | ++ | +++ | +++ | |
| 133/134 | A173V/H366E | ++ | ++ | ++ | +++ | |
| 135/136 | G25E/D180G/L288K/Q362E | | +++ | + | | |
| 137/138 | D267T | ++ | ++ | | ++ | ++ |
| 139/140 | Q333F | + | ++ | | ++ | + |
| 141/142 | P361V | + | + | + | ++ | |
| 143/144 | A170P | ++ | + | | | |
| 145/146 | Q275N | ++ | ++ | + | ++ | + |
| 147/148 | A271D | ++ | ++ | | ++ | ++ |
| 149/150 | P295G | + | ++ | | ++ | ++ |
| 151/152 | H366R | ++ | + | ++ | | ++ |
| 153/154 | A170W | +++ | | | | ++ |
| 155/156 | I322A | ++ | ++ | + | +++ | +++ |
| 157/158 | Q392H | +++ | ++ | ++ | ++ | ++ |
| 159/160 | E278C | ++ | ++ | ++ | ++ | ++ |
| 161/162 | I322E | | | | ++ | |
| 163/164 | D232P | | | | + | ++ |
| 165/166 | S296G/A344V | | + | | ++ | ++ |
| 167/168 | A142L | | | | | ++ |
| 169/170 | H179S/D251N | | | | | +++ |
| 171/172 | A142S | ++ | + | | + | |
| 173/174 | E287V | ++ | ++ | | ++ | ++ |
| 175/176 | L309A | ++ | + | | + | ++ |
| 177/178 | H179A | + | ++ | ++ | ++ | |
| 179/180 | Q304R | ++ | + | + | ++ | + |
| 181/182 | A301N | | | | | ++ |
| 183/184 | I322K | +++ | ++ | ++ | +++ | +++ |
| 185/186 | R177T | + | | | | ++ |
| 187/188 | R152A | + | + | | | ++ |
| 189/190 | E54Q | ++ | + | ++ | + | ++ |
| 191/192 | R2S | +++ | ++ | | ++ | +++ |
| 193/194 | R327M | ++ | + | | + | + |

TABLE 3-1-continued

Methionine Gamma Lyase Activity (Relative to SEQ ID NO: 2)[1]

| SEQ ID NO: (nt/aa) | Amino Acid Differences (Relative to SEQ ID NO: 2) | FIOP Unchallenged | FIOP Low Met | FIOP 61° C. | FIOP pH 5.2 | FIOP Protease |
|---|---|---|---|---|---|---|
| 195/196 | E54R/A145S | +++ | ++ | + | ++ | |
| 197/198 | Y193S | +++ | ++ | | ++ | ++ |
| 199/200 | E54I | | + | | | ++ |
| 201/202 | G55K | +++ | +++ | + | +++ | +++ |
| 203/204 | K395H | ++ | + | | | ++ |
| 205/206 | R2T | | ++ | | | |

[1]Levels of increased activity were determined relative to the reference polypeptide of SEQ ID NO: 2, and defined as follows:
"+" > 0.9;
"++" > 1.1;
"+++" > 1.5; and
"++++" > 3.

Based on the results shown in Table 3-1, SEQ ID NO: 94 was chosen as the next backbone for evolution. Beneficial mutations identified from the results shown in Table 3-1 were recombined into the backbone. The variants were screened as described in Example 2. The only difference is that the heat challenge was performed at 65° C. instead of 61° C. The data relative to SEQ ID NO: 94 are listed in Table 3-2. In this Table, the amino acid differences are indicated relative to SEQ ID NO: 94.

TABLE 3-2

Methionine Gamma Lyase Activity (Relative to SEQ ID NO: 94)[1]

| SEQ ID NO: (nt/aa) | Amino Acid Differences (Relative to SEQ ID NO: 94) | Amino Acid Differences (Relative to SEQ ID NO: 2) | FIOP Unchallenged | FIOP Low Met | FIOP 65° C. | FIOP Protease |
|---|---|---|---|---|---|---|
| 207/208 | Y38F/G55P/K150T/Y189L/A290N/I322A/P361V/H366E | Y38F/G55P/L69I/K150T/Y189L/I322A/A344T/P361V/H366E | + | | ++++ | |
| 209/210 | Y38F/G55K/I322K/H366E | Y38F/G55K/L69I/N290A/I322K/A344T/H366E | | | ++++ | +++ |
| 211/212 | Y38F/Q304R | Y38F/L69I/N290A/Q304R/A344T | | | +++ | + |
| 213/214 | Y38F/G55P/Q275N/E278C/A290N/P361V/H366E | Y38F/G55P/L69I/Q275N/E278C/A344T/P361V/H366E | | | +++ | + |
| 215/216 | G55H | G55H/L69I/N290A/A344T | ++ | + | + | ++ |
| 217/218 | Y38F/G55H/Y189L/P361V | Y38F/G55H/L69I/Y189L/N290A/A344T/P361V | +++ | | +++ | |
| 219/220 | G55K/A290N/I322A | G55K/L69I/I322A/A344T | ++ | ++ | ++ | |
| 221/222 | Y38F/I322A | Y38F/L69I/N290A/I322A/A344T | | | +++ | |
| 223/224 | Y38F/G55P/Y189L/I322A/H366E | Y38F/G55P/L69I/Y189L/N290A/I322A/A344T/H366E | +++ | | ++++ | |
| 225/226 | Y38F/A290N/I322A/P361V | Y38F/L69I/I322A/A344T/P361V | ++ | | +++ | |
| 227/228 | Y38F/P149T/Y189L/Q275N/I322K | Y38F/L69I/P149T/Y189L/Q275N/N290A/I322K/A344T | ++ | | +++ | |
| 229/230 | Y38F/P361V | Y38F/L69I/N290A/A344T/P361V | | | ++ | + |
| 231/232 | Y38F/K150T/Y189L/I322K/P361V/H366E | Y38F/L69I/K150T/Y189L/N290A/I322K/A344T/P361V/H366E | + | | +++ | |
| 233/234 | E278C/H366E | L69I/E278C/N290A/A344T/H366E | | | ++ | ++ |
| 235/236 | Y189L | L69I/Y189L/N290A/A344T | +++ | | +++ | |
| 237/238 | Y38F/G55E/Y189L/E278C/P361V/H366E | Y38F/G55E/L69I/Y189L/E278C/N290A/A344T/P361V/H366E | + | | +++ | |
| 239/240 | Y38F/G55E/Y189L/I322A | Y38F/G55E/L69I/Y189L/N290A/I322A/A344T | ++ | | ++++ | |
| 241/242 | Y38F/G55K/Y189L/I322A/H366E | Y38F/G55K/L69I/Y189L/N290A/I322A/A344T/H366E | ++ | | ++++ | |
| 243/244 | G55K/Q275N | G55K/L69I/Q275N/N290A/A344T | | | + | ++ |

TABLE 3-2-continued

Methionine Gamma Lyase Activity (Relative to SEQ ID NO: 94)[1]

| SEQ ID NO: (nt/aa) | Amino Acid Differences (Relative to SEQ ID NO: 94) | Amino Acid Differences (Relative to SEQ ID NO: 2) | FIOP Unchallenged | FIOP Low Met | FIOP 65° C. | FIOP Protease |
|---|---|---|---|---|---|---|
| 245/246 | Y38F/Y189L | Y38F/L69I/Y189L/N290A/A344T | +++ | + | ++++ | |
| 247/248 | G55K/Q304R/H366E | G55K/L69I/N290A/Q304R/A344T/H366E | + | ++ | +++ | +++ |
| 249/250 | G55K/Y189L/I322K/P361V/H366E | G55K/L69I/Y189L/N290A/I322K/A344T/P361V/H366E | +++ | + | +++ | |
| 251/252 | Y38F | Y38F/L69I/N290A/A344T | ++ | + | +++ | ++ |
| 253/254 | G55K/Q275N/H366E | G55K/L69I/Q275N/N290A/A344T/H366E | | | +++ | +++ |
| 255/256 | Y38F/Y189L/Q304R/I322A | Y38F/L69I/Y189L/N290A/Q304R/I322A/A344T | +++ | + | ++++ | |
| 257/258 | K150T/Y189L/A290N | L69I/K150T/Y189L/A344T | ++ | | +++ | |
| 259/260 | Y38F/G55H/A290N/Q304R/I322K/P361V/H366E | Y38F/G55H/L69I/Q304R/I322K/A344T/P361V/H366E | ++ | + | +++ | ++ |
| 261/262 | Y38F/Y189L/Q304R/H366E | Y38F/L69I/Y189L/N290A/Q304R/A344T/H366E | ++ | | ++++ | |
| 263/264 | Y38F/G55P/Y189L/Q304R/I322K | Y38F/G55P/L69I/Y189L/N290A/Q304R/I322K/A344T | + | | ++++ | |
| 265/266 | G55H/Q275N | G55H/L69I/Q275N/N290A/A344T | | + | ++ | ++ |
| 267/268 | Y189L/I322K | L69I/Y189L/N290A/I322K/A344T | +++ | + | ++ | |
| 269/270 | Y38F/H366E | Y38F/L69I/N290A/A344T/H366E | ++ | ++ | +++ | +++ |
| 271/272 | Y38F/Y189L/Q275N/I322K/H366E | Y38F/L69I/Y189L/Q275N/N290A/I322K/A344I/H366E | ++ | | +++ | |
| 273/274 | G55K | G55K/L69I/N290A/A344T | ++ | ++ | ++ | +++ |
| 275/276 | Y38F/E278C | Y38F/L69I/E278C/N290A/A344T | | | +++ | + |
| 277/278 | Y38F/Y189L/A290N/I322K | Y38F/L69I/Y189L/I322K/A344T | +++ | | +++ | |
| 279/280 | Y38F/G55H/Y189L/A290N/P361V/H366E | Y38F/G55H/L69I/Y189L/A344T/P361V/H366E | +++ | + | ++++ | |
| 281/282 | Y38F/G55E/Y189L/Q275N/A290N/P361V | Y38F/G55E/L69I/Y189L/Q275N/A344T/P361V | ++ | | ++ | |
| 283/284 | Y38F/G55E/Q304R | Y38F/G55E/L69I/N290A/Q304R/A344T | | + | +++ | ++ |
| 285/286 | Y38F/Q275N | Y38F/L69I/Q275N/N290A/A344T | | | +++ | + |
| 287/288 | Y38F/A290N | Y38F/L69I/A344T | | | +++ | |
| 289/290 | Y38F/G55E | Y38F/G55E/L69I/N290A/A344T | | + | +++ | + |
| 291/292 | Y38F/G55K | Y38F/G55K/L69I/N290A/A344T | + | + | ++++ | ++ |
| 293/294 | Y38F/G55K/Y189L/Q275N | Y38F/G55K/L69I/Y189L/Q275N/N290A/A344T | ++ | | ++++ | |
| 295/296 | Y38F/G55E/Y189L | Y38F/G55E/L69I/Y189L/N290A/A344T | +++ | | ++++ | |
| 297/298 | A388R | L69I/N290A/A344T/A388R | + | + | ++ | + |

[1]Levels of increased activity were determined relative to the reference polypeptide of SEQ ID NO: 94, and defined as follows:
"+" > 0.9;
"++" > 1.1;
"+++" > 1.5; and
"++++" > 3.

Based on the results shown in Table 3-2, SEQ ID NO: 248 was chosen as the next backbone for evolution. Beneficial mutations identified from the results shown in Table 3-2 were recombined into the backbone. Additionally, variants were also constructed on SEQ ID NO: 248 through saturation mutagenesis at different positions. The variants were assayed as described in Example 2. The only difference was that the heat challenge prior to low pH challenge was performed at 68° C. instead of 65° C. The results are provided in Table 3-3. In this Table, the amino acid differences are indicated relative to SEQ ID NO: 248.

TABLE 3-3

Methionine Gamma Lyase Activity (Relative to SEQ ID NO: 248)[1]

| SEQ ID NO: (nt/aa) | Amino Acid Differences (Relative to SEQ ID NO: 248) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 299/300 | V29T/A47G/ H279W/Q283H/ S358T | V29T/A47G/G55K/L69I/ H279W/Q283H/N290A/ Q304R/A344T/S358T/ H366E | | | | +++ |
| 301/302 | Q34L/A68D/ I132V/S253M/ Q283H | Q34L/G55K/A68D/L69I/ I132V/S253M/Q283H/ N290A/Q304R/A344T/ H366E | | | | +++ |
| 303/304 | T220V | G55K/L69I/T220V/N290A/ Q304R/A344T/H366E | | | +++ | + |
| 305/306 | A68D/S358T | G55K/A68D/L69I/N290A/ Q304R/A344T/S358T/ H366E | + | ++ | +++ | |
| 307/308 | S358T | G55K/L69I/N290A/Q304R/ A344T/S358T/H366E | + | + | ++ | +++ |
| 309/310 | Q34L | Q34L/G55K/L69I/N290A/ Q304R/A344T/H366E | | | | +++ |
| 311/312 | A68D/Q283H | G55K/A68D/L69I/Q283H/ N290A/Q304R/A344T/ H366E | + | | ++ | |
| 313/314 | V29T/T220V | V29T/G55K/L69I/T220V/ N290A/Q304R/A344T/ H366E | | | | +++ |
| 315/316 | Q34L/I132V/ H279W/S358T | Q34L/G55K/L69I/I132V/ H279W/N290A/Q304R/ A344T/S358T/H366E | | | | +++ |
| 317/318 | A47G/G126A/ E237V/H279W | A47G/G55K/L69I/G126A/ E237V/H279W/N290A/ Q304R/A344T/H366E | + | | | +++ |
| 319/320 | V43A/R102A | V43A/G55K/L69I/R102A/ N290A/Q304R/A344T/ H366E | + | ++ | | + |
| 321/322 | V29T/Q34L/ A68D/T220V/ S253M/H279W/ Q283H/S358T | V29T/Q34L/G55K/A68D/ L69I/T220V/S253M/ H279W/Q283H/N290A/ Q304R/A344T/S358T/H366E | | | | +++ |
| 323/324 | V29T/A47G/ A68D/R102A/ I132V/T220V/ H250F/S358T | V29T/A47G/G55K/A68D/ L69I/R102A/I132V/T220V/ H250F/N290A/Q304R/ A344T/S358T/H366E | | | | +++ |
| 325/326 | V29T | V29T/G55K/L69I/N290A/ Q304R/A344T/H366E | ++ | + | | ++ |
| 327/328 | V29T/Q34L/ H279W | V29T/Q34L/G55K/L69I/ H279W/N290A/Q304R/ A344T/H366E | + | +++ | | + |
| 329/330 | Q34L/V43A/ A47G/Q283H | Q34L/V43A/A47G/G55K/ L69I/Q283H/N290A/ Q304R/A344T/H366E | | | | +++ |
| 331/332 | Y38F/A173V | Y38F/G55K/L69I/A173V/ N290A/Q304R/A344T/ H366E | | | +++ | + |
| 333/334 | Q165R/Y189L/ Q283H/A290N/ S336H | G55K/L69I/Q165R/Y189L/ Q283H/Q304R/S336H/ A344T/H366E | +++ | | | |
| 335/336 | Y38F/A173V/ Y189L/A290N | Y38F/G55K/L69I/A173V/ Y189L/Q304R/A344T/ H366E | +++ | +++ | ++ | |
| 337/338 | E54Q/Y189L/ I322A | E54Q/G55K/L69I/Y189L/ N290A/Q304R/I322A/ A344T/H366E | +++ | + | ++ | |
| 339/340 | Y189L | G55K/L69I/Y189L/N290A/ Q304R/A344T/H366E | +++ | | | |
| 341/342 | Y38F | Y38F/G55K/L69I/N290A/ Q304R/A344T/H366E | | | +++ | + |
| 343/344 | Y38F/I322A | Y38F/G55K/L69I/N290A/ Q304R/I322A/A344T/ H366E/ | + | ++++ | | |
| 345/346 | Y38F/A173V/ I322A | Y38F/G55K/L69I/A173V/ N290A/Q304R/I322A/ A344T/H366E | + | ++ | ++++ | |
| 347/348 | Q165R/Y189L | G55K/L69I/Q165R/Y189L/ N290A/Q304R/A344T/ H366E | +++ | + | | |

TABLE 3-3-continued

Methionine Gamma Lyase Activity (Relative to SEQ ID NO: 248)[1]

| SEQ ID NO: (nt/aa) | Amino Acid Differences (Relative to SEQ ID NO: 248) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 349/350 | E54Q/Q165R/ Y189L/A290N/ S336H | E54Q/G55K/L69I/Q165R/ Y189L/Q304R/S336H/ A344T/H366E | +++ | ++ | | |
| 351/352 | Q165R/A173V/ Y189L/Q283H | G55K/L69I/Q165R/A173V/ Y189L/Q283H/N290A/ Q304R/A344T/H366E | +++ | + | + | |
| 353/354 | Y38F/E54Q/ S336H | Y38F/E54Q/G55K/L69I/ N290A/Q304R/S336H/ A344T/H366E | ++ | | ++++ | |
| 355/356 | Y38F/Q165R/ A173V/Y189L | Y38F/G55K/L69I/Q165R/ A173V/Y189L/N290A/ Q304R/A344T/H366E | +++ | + | +++ | |
| 357/358 | Y38F/E54Q/ A173V/Q283H/ I322A/S336H | Y38F/E54Q/G55K/L69I/ A173V/Q283H/N290A/ Q304R/I322A/S336H/ A344T/H366E | | | ++++ | |
| 359/360 | A173V/Y189L/ Q283H/S336H | G55K/L69I/A173V/Y189L/ Q283H/N290A/Q304R/ S336H/A344T/H366E | +++ | +++ | | |
| 361/362 | E54Q/Q165R/ A173V/A290N/ I322A | E54Q/G55K/L69I/Q165R/ A173V/Q304R/I322A/ A344T/H366E | ++ | +++ | | |
| 363/364 | Y38F/E54Q/ Q283H/S336H | Y38F/E54Q/G55K/L69I/ Q283H/N290A/Q304R/ S336H/A344T/H366E | ++ | + | ++++ | |
| 365/366 | Y38F/A173V/ Y189L/A290N/ I322A | Y38F/G55K/L69I/A173V/ Y189L/Q304R/I322A/ A344T/H366E | +++ | ++ | +++ | + |
| 367/368 | Y38F/E54Q/ Q165R/A173V/ Q283H/S336H | Y38F/E54Q/G55K/L69I/ Q165R/A173V/Q283H/ N290A/Q304R/S336H/ A344T/H366E | ++ | +++ | ++++ | |
| 369/370 | Y38F/E54Q/ Y189L/Q283H | Y38F/E54Q/G55K/L69I/ Y189L/Q283H/N290A/ Q304R/A344T/H366E | +++ | | +++ | |
| 371/372 | A290N/ | G55K/L69I/Q304R/A344T/ H366E | ++ | +++ | | |
| 373/374 | Y38F/Q165R/ Q283H | Y38F/G55K/L69I/Q165R/ Q283H/N290A/Q304R/ A344T/H366E | ++ | ++ | +++ | ++ |
| 375/376 | Y38F/Q283H | Y38F/G55K/L69I/Q283H/ N290A/Q304R/A344T/ H366E | ++ | +++ | +++ | |
| 377/378 | Y38F/A173V/ Q283H/S336H | Y38F/G55K/L69I/A173V/ Q283H/N290A/Q304R/ S336H/A344T/H366E | | | ++++ | |
| 379/380 | E54Q/A173V/ Q283H | E54Q/G55K/L69I/A173V/ Q283H/N290A/Q304R/ A344T/H366E | + | +++ | + | |
| 381/382 | L334V | G55K/L69I/N290A/Q304R/ L334V/A344T/H366E | | ++ | + | |
| 383/384 | A87G | G55K/L69I/A87G/N290A/ Q304R/A344T/H366E | ++ | + | | |
| 385/386 | G126S | G55K/L69I/G126S/N290A/ Q304R/A344T/H366E | ++ | + | | |
| 387/388 | S357G | G55K/L69I/N290A/Q304R/ A344T/S357G/H366E | ++ | | | |
| 389/390 | K240R | G55K/L69I/K240R/N290A/ Q304R/A344T/H366E | + | | + | +++ |
| 391/392 | F50L | F50L/G55K/L69I/N290A/ Q304R/A344T/H366E | ++ | | | |
| 393/394 | L236C | G55K/L69I/L236C/N290A/ Q304R/A344T/H366E | ++ | + | | |
| 395/396 | E317R | G55K/L69I/N290A/Q304R/ E317R/A344T/H366E | ++ | | | |
| 397/398 | K240P | G55K/L69I/K240P/N290A/ Q304R/A344T/H366E | ++ | | | |
| 399/400 | H367A | G55K/L69I/N290A/Q304R/ A344T/H366E/H367A | ++ | + | ++ | + |
| 401/402 | T112A | G55K/L69I/T112A/N290A/ Q304R/A344T/H366E | ++ | | | |
| 403/404 | S11M | S11M/G55K/L69I/N290A/ Q304R/A344T/H366E | | ++ | ++ | ++ |

TABLE 3-3-continued

Methionine Gamma Lyase Activity (Relative to SEQ ID NO: 248)[1]

| SEQ ID NO: (nt/aa) | Amino Acid Differences (Relative to SEQ ID NO: 248) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 405/406 | L236A | G55K/L69I/L236A/N290A/ Q304R/A344T/H366E | + | ++ | | |
| 407/408 | S11C | S11C/G55K/L69I/N290A/ Q304R/A344T/H366E | + | ++ | +++ | + |
| 409/410 | R364L | G55K/L69I/N290A/Q304R/ A344T/R364L/H366E | ++ | ++ | | |
| 411/412 | G126R | G55K/L69I/G126R/N290A/ Q304R/A344T/H366E | ++ | ++ | | |
| 413/414 | S11A | S11A/G55K/L69I/N290A/ Q304R/A344T/H366E | ++ | ++ | ++ | ++ |
| 415/416 | S357A | G55K/L69I/N290A/Q304R/ A344T/S357A/H366E | ++ | + | | |
| 417/418 | S11G | S11G/G55K/L69I/N290A/ Q304R/A344T/H366E | ++ | ++ | | + |
| 419/420 | S11H | S11H/G55K/L69I/N290A/ Q304R/A344T/H366E | ++ | ++ | | |
| 421/422 | S11R | S11R/G55K/L69I/N290A/ Q304R/A344T/H366E | ++ | ++ | | + |
| 423/424 | F58T | G55K/F58T/L69I/N290A/ Q304R/A344T/H366E | ++ | ++ | | |
| 425/426 | A68G | G55K/A68G/L69I/N290A/ Q304R/A344T/H366E | + | + | | |
| 427/428 | G126E | G55K/L69I/G126E/N290A/ Q304R/A344T/H366E | + | ++ | | |
| 429/430 | A290Q | G55K/L69I/N290Q/Q304R/ A344T/H366E | + | + | + | ++ |
| 431/432 | K240D | G55K/L69I/K240D/N290A/ Q304R/A344T/H366E | ++ | + | + | |
| 433/434 | F50V | F50V/G55K/L69I/N290A/ Q304R/A344T/H366E | ++ | | | +++ |
| 435/436 | F50M | F50M/G55K/L69I/N290A/ Q304R/A344T/H366E | +++ | | | +++ |
| 437/438 | A290V | G55K/L69I/N290V/Q304R/ A344T/H366E | ++ | + | | + |
| 439/440 | H279F | G55K/L69I/H279F/N290A/ Q304R/A344T/H366E | ++ | + | + | + |
| 441/442 | S358L | G55K/L69I/N290A/Q304R/ A344T/S358L/H366E | ++ | | | |
| 443/444 | K240G | G55K/L69I/K240G/N290A/ 0304R/A344T/H366E | ++ | | | |

[1]Levels of increased activity were determined relative to the reference polypeptide of SEQ ID NO: 248, and defined as follows:
"+" > 0.9/
"++" > 1.1;
"+++" > 1.5; and
"++++" > 3.

Based on the results from Table 3-3, SEQ ID NO: 352 was chosen as the next backbone for evolution. Beneficial mutations identified based on the results shown in Table 3-3 were recombined into the backbone. The variants were assayed as described in Example 2. The only difference was that the heat challenge prior to low pH challenge was performed at 68° C. instead of 65° C. The results are provided in Table 3-4. In this Table, the amino acid differences are indicated relative to SEQ ID NO: 352.

TABLE 3-4

Methionine Gamma Lyase Activity (Relative to SEQ ID NO: 352)[1]

| SEQ ID NO: (nt/aa) | Amino Acid Differences (Relative to SEQ ID NO: 352) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 445/446 | S11M/F50M/ A68D/G126A/ A290Q | S11M/F50M/G55K/A68D/ L69I/G126A/Q165R/ A173V/Y189L/Q283H/ N290Q/Q304R/A344T/ H366E | | | | +++ |

TABLE 3-4-continued

Methionine Gamma Lyase Activity (Relative to SEQ ID NO: 352)[1]

| SEQ ID NO: (nt/aa) | Amino Acid Differences (Relative to SEQ ID NO: 352) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 447/448 | S11M/Y38F/ F50M/E54Q/ G126A/L189Y/ S336H/I390L/ D391E | S11M/Y38F/F50M/E54Q/ G55K/L69I/G126A/Q165R/ A173V/Q283H/N290A/ Q304R/S336H/A344T/ H366E/I390L/D391E | | | +++ | +++ |
| 449/450 | S11A/F50M/ A68D/L189Y/ K240R | S11A/F50M/G55K/A68D/ L69I/Q165R/A173V/ K240R/Q283H/N290A/ Q304R/A344T/H366E | + | | | ++++ |
| 451/452 | S11A/Y38F/ E54Q/L189Y/ K240R/A290V | S11A/Y38F/E54Q/G55K/ L69I/Q165R/A173V/ K240R/Q283H/N290V/ Q304R/A344T/H366E | | | +++ | ++ |
| 453/454 | S11C/Y38F/ A290Q | S11C/Y38F/G55K/L69I/ Q165R/A173V/Y189L/ Q283H/N290Q/Q304R/ A344T/H366E | ++ | + | +++ | |
| 455/456 | S11M/A290V | S11M/G55K/L69I/Q165R/ A173V/Y189L/Q283H/ N290V/Q304R/A344T/ H366E | + | + | ++ | +++ |
| 457/458 | S11M/I322A | S11M/G55K/L69I/Q165R/ A173V/Y189L/Q283H/ N290A/Q304R/I322A/ A344T/H366E | + | + | +++ | +++ |
| 459/460 | I322A | G55K/L69I/Q165R/A173V/ Y189L/Q283H/N290A/ Q304R/I322A/A344T/ H366E | | ++ | ++ | + |
| 461/462 | S11M/Y38F/ A290Q/I322A | S11M/Y38F/G55K/L69I/ Q165R/A173V/Y189L/ Q283H/N290Q/Q304R/ I322A/A344T/H366E | ++ | ++ | ++++ | ++ |
| 463/464 | S11A/L189Y/ A290Q/I322A | S11A/G55K/L69I/Q165R/ A173V/Q283H/N290Q/ Q304R/I322A/A344T/ H366E | | ++ | ++ | |
| 465/466 | S11A/Y38F/ L189Y/A290V/ H367A | S11A/Y38F/G55K/L69I/ Q165R/A173V/Q283H/ N290V/Q304R/A344T/ H366E/H367A | | + | ++++ | |
| 467/468 | S11M/F50V/ K240R/H250S/ A290Q | S11M/F50V/G55K/L69I/ Q165R/A173V/Y189L/ K240R/H250S/Q283H/ N290Q/Q304R/A344T/ H366E | | | | +++ |
| 469/470 | S11A/Y38F/ L189Y | S11A/Y38F/G55K/L69I/ Q165R/A173V/Q283H/ N290A/Q304R/A344T/ H366E | | + | ++++ | |
| 471/472 | S11A/Y38F/ G126A/I322A/ S336H | S11A/Y38F/G55K/L69I/ G126A/Q165R/A173V/ Y189L/Q283H/N290A/ Q304R/I322A/S336H/ A344T/H366E | ++ | ++ | +++ | ++ |
| 473/474 | S11M/K240R/ H250S/A290Q | S11M/G55K/L69I/Q165R/ A173V/Y189L/K240R/ H250S/Q283H/N290Q/ Q304R/A344T/H366E | | | | ++++ |
| 475/476 | Y38F/E54Q/ L236A | Y38F/E54Q/G55K/L69I/ Q165R/A173V/Y189L/ L236A/Q283H/N290A/ Q304R/A344T/H366E | ++ | ++ | +++ | |
| 477/478 | S11M | S11M/G55K/L69I/Q165R/ A173V/Y189L/Q283H/ N290A/Q304R/A344T/ H366E | ++ | ++ | ++ | ++ |
| 479/480 | S11M/F50M/ A68D/A290Q | S11M/F50M/G55K/A68D/ L69I/Q165R/A173V/ Y189L/Q283H/N290Q/ Q304R/A344T/H366E | | | | +++ |

TABLE 3-4-continued

Methionine Gamma Lyase Activity (Relative to SEQ ID NO: 352)[1]

| SEQ ID NO: (nt/aa) | Amino Acid Differences (Relative to SEQ ID NO: 352) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 481/482 | S11A/Y38F/ E54Q/H250F/ S336H | S11A/Y38F/E54Q/G55K/ L69I/Q165R/A173V/ Y189L/H250F/Q283H/ N290A/Q304R/S336H/ A344T/H366E | ++ | | ++ | |
| 483/484 | Y38F/G126A/ L189Y/H367A | Y38F/G55K/L69I/G126A/ Q165R/A173V/Q283H/ N290A/Q304R/A344T/ H366E/H367A | | ++ | ++++ | |
| 485/486 | S11M/Y38F/ A290Q/I322A/ S336H/H367A | S11M/Y38F/G55K/L69I/ Q165R/A173V/Y189L/ Q283H/N290Q/Q304R/ I322A/S336H/A344T/ H366E/H367A | ++ | + | ++++ | |
| 487/488 | S11A/F50M/ G126A | S11A/F50M/G55K/L69I/ G126A/Q165R/A173V/ Y189L/Q283H/N290A/ Q304R/A344T/H366E | | | | ++++ |
| 489/490 | F50M/E54Q/ G126A/K240R/ H250F/A290Q | F50M/E54Q/G55K/L69I/ G126A/Q165R/A173V/ Y189L/K240R/H250F/ Q283H/N290Q/Q304R/ A344T/H366E | | | | +++ |
| 491/492 | S11C/Y38F/ F50M/E54Q/ G126A/K240R/ A290V | S11C/Y38F/F50M/E54Q/ G55K/L69I/G126A/Q165R/ A173V/Y189L/K240R/ Q283H/N290V/Q304R/ A344T/H366E | | | | +++ |
| 493/494 | A68D | G55K/A68D/L69I/Q165R/ A173V/Y189L/Q283H/ N290A/Q304R/A344T/ H366E | ++ | ++ | ++ | |
| 495/496 | S11A/E54Q/ L189Y | S11A/E54Q/G55K/L69I/ Q165R/A173V/Q283H/ N290A/Q304R/A344T/ H366E | | ++ | ++ | |
| 497/498 | S11A/Y38F/ F50M/K240R | S11A/Y38F/F50M/G55K/ L69I/Q165R/A173V/ Y189L/K240R/Q283H/ N290A/Q304R/A344T/ H366E | | | | ++++ |
| 499/500 | S11M/Y38F/ L189Y/I322A | S11M/Y38F/G55K/L69I/ Q165R/A173V/Q283H/ N290A/Q304R/I322A/ A344T/H366E | | ++ | ++++ | |
| 501/502 | S11A/Y38F/ E54Q/A68D/ G126A/A290V/ S336H/H367A | S11A/Y38F/E54Q/G55K/ A68D/L69I/G126A/Q165R/ A173V/Y189L/Q283H/ N290V/Q304R/S336H/ A344T/H366E/H367A | | | ++++ | |
| 503/504 | S11M/Y38F/ G126A/L189Y/ I322A/H367A | S11M/Y38F/G55K/L69I/ G126A/Q165R/A173V/ Q283H/N290A/Q304R/ I322A/A344T/H366E/ H367A | | + | ++++ | |
| 505/506 | F50V/K240R | F50V/G55K/L69I/Q165R/ A173V/Y189L/K240R/ Q283H/N290A/Q304R/ A344T/H366E | | | | ++++ |
| 507/508 | S11A/F50M/ H367A | S11A/F50M/G55K/L69I/ Q165R/A173V/Y189L/ Q283H/N290A/Q304R/ A344T/H366E/H367A | | | | +++ |
| 509/510 | S11A/Y38F/ F50M/A290Q/ H367A | S11A/Y38F/F50M/G55K/ L69I/Q165R/A173V/ Y189L/Q283H/N290Q/ Q304R/A344T/H366E/ H367A | | | | +++ |
| 511/512 | S11C/Y38F/ F50V/E54Q/ G126A/K240R/ H367A | S11C/Y38F/F50V/E54Q/ G55K/L69I/G126A/Q165R/ A173V/Y189L/K240R/ Q283H/N290A/Q304R/ A344T/H366E/H367A | | | | +++ |

TABLE 3-4-continued

Methionine Gamma Lyase Activity (Relative to SEQ ID NO: 352)[1]

| SEQ ID NO: (nt/aa) | Amino Acid Differences (Relative to SEQ ID NO: 352) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 513/514 | S11M/Y38F/ E54Q/L189Y/ A290V | S11M/Y38F/E54Q/G55K/ L69I/Q165R/A173V/ Q283H/N290V/Q304R/ A344T/H366E | | + | ++++ | |
| 515/516 | S336H | G55K/L69I/Q165R/A173V/ Y189L/Q283H/N290A/ Q304R/S336H/A344T/H366E | + | ++ | ++ | ++ |
| 517/518 | S11M/Y38F/ H250F/S336H | S11M/Y38F/G55K/L69I/ Q165R/A173V/Y189L/ H250F/Q283H/N290A/ Q304R/S336H/A344T/ H366E | ++ | + | +++ | |
| 519/520 | S11M/Y38F/ F50M/E54Q/ H250S/A290Q | S11M/Y38F/F50M/E54Q/ G55K/L69I/Q165R/A173V/ Y189L/H250S/Q283H/ N290Q/Q304R/A344T/ H366E | + | | | ++++ |
| 521/522 | S11M/Y38F/ F50M/G126A/ L189Y/K240R/ H250F/A290Q | S11M/Y38F/F50M/G55K/ L69I/G126A/Q165R/ A173V/K240R/H250F/ Q283H/N290Q/Q304R/ A344T/H366E | + | | | ++++ |
| 523/524 | S11M/Y38F/ L189Y/K240R | S11M/Y38F/G55K/L69I/ Q165R/A173V/K240R/ Q283H/N290A/Q304R/ A344T/H366E | | | ++++ | +++ |
| 525/526 | S11M/Y38F/ F50M/K240R | S11M/Y38F/F50M/G55K/ L69I/Q165R/A173V/ Y189L/K240R/Q283H/ N290A/Q304R/A344T/ H366E | | | | ++++ |
| 527/528 | S11M/S336H | S11M/G55K/L69I/Q165R/ A173V/Y189L/Q283H/ N290A/Q304R/S336H/ A344T/H366E | ++ | ++ | ++ | ++ |
| 529/530 | S11M/A290V/ S336H | S11M/G55K/L69I/Q165R/ A173V/Y189L/Q283H/ N290V/Q304R/S336H/ A344T/H366E | + | ++ | +++ | +++ |
| 531/532 | K240R | G55K/L69I/Q165R/A173V/ Y189L/K240R/Q283H/ N290A/Q304R/A344T/ H366E | | | | ++++ |
| 533/534 | Y38F/G126A/ K240R | Y38F/G55K/L69I/G126A/ Q165R/A173V/Y189L/ K240R/Q283H/N290A/ Q304R/A344T/H366E | | | +++ | ++++ |
| 535/536 | Y38F/G126A/ K240R/A290V | Y38F/G55K/L69I/G126A/ Q165R/A173V/Y189L/ K240R/Q283H/N290V/ Q304R/A344T/H366E | | | +++ | +++ |
| 537/538 | Y38F/F50V/ E54Q/L189Y/ H367A | Y38F/F50V/E54Q/G55K/ L69I/Q165R/A173V/ Q283H/N290A/Q304R/ A344T/H366E/H367A | | | ++++ | +++ |
| 539/540 | S11A/K240R/ A290Q | S11A/G55K/L69I/Q165R/ A173V/Y189L/K240R/ Q283H/N290Q/Q304R/ A344T/H366E | + | | | ++++ |
| 541/542 | F50M/E54Q/ A68D | F50M/E54Q/G55K/A68D/ L69I/Q165R/A173V/ Y189L/Q283H/N290A/ Q304R/A344T/H366E | | | | +++ |
| 543/544 | S11A/Y38F/ F50M/E54Q/ G126A/L189Y/ I322A | S11A/Y38F/F50M/E54Q/ G55K/L69I/G126A/Q165R/ A173V/Q283H/N290A/ Q304R/I322A/A344T/ H366E | ++ | | ++ | +++ |
| 545/546 | F50M/E54Q/ K240R/I322A | F50M/E54Q/G55K/L69I/ Q165R/A173V/Y189L/ K240R/Q283H/N290A/ Q304R/I322A/A344T/ H366E | | | | +++ |

TABLE 3-4-continued

Methionine Gamma Lyase Activity (Relative to SEQ ID NO: 352)[1]

| SEQ ID NO: (nt/aa) | Amino Acid Differences (Relative to SEQ ID NO: 352) | Amino Acid Differences (Relative to SEQ ID NO: 2) | FIOP Unchallenged | FIOP Low Met | FIOP 68° C./ pH 5.2 | FIOP Protease |
|---|---|---|---|---|---|---|
| 547/548 | S11M/Y38F/ E54Q | S11M/Y38F/E54Q/G55K/ L69I/Q165R/A173V/ Y189L/Q283H/N290A/ Q304R/A344T/H366E | ++ | ++ | +++ | |
| 549/550 | S11M/E54Q/ G126A | S11M/E54Q/G55K/L69I/ G126A/Q165R/A173V/ Y189L/Q283H/N290A/ Q304R/A344T/H366E/ | ++ | ++ | ++ | + |
| 551/552 | S11A/E54Q | S11A/E54Q/G55K/L69I/ Q165R/A173V/Y189L/ Q283H/N290A/Q304R/ A344T/H366E | ++ | + | + | |
| 553/554 | S11M/Y38F/ F50M/A68D | S11M/Y38F/F50M/G55K/ A68D/L69I/Q165R/ A173V/Y189L/Q283H/ N290A/Q304R/A344T/ H366E | | | | +++ |
| 555/556 | S11M/L394P | S11M/G55K/L69I/Q165R/ A173V/Y189L/Q283H/ N290A/Q304R/A344T/ H366E/L394P | ++ | + | ++ | ++ |
| 557/558 | S11M/Y38F/ A68D/L189Y/ K240R/A290Q/ H367A | S11M/Y38F/G55K/A68D/ L69I/Q165R/A173V/ K240R/Q283H/N290Q/ Q304R/A344T/H366E/ H367A | | + | ++++ | |
| 559/560 | S11M/Y38F/ S336H | S11M/Y38F/G55K/L69I/ Q165R/A173V/Y189L/ Q283H/N290A/Q304R/ S336H/A344T/H366E | ++ | + | +++ | |
| 561/562 | S11M/Y38F | S11M/Y38F/G55K/L69I/ Q165R/A173V/Y189L/ Q283H/N290A/Q304R/ A344T/H366E | ++ | + | +++ | |

[1]Levels of increased activity were determined relative to the reference polypeptide of SEQ ID NO: 352, and defined as follows:
"+" > 0.9;
"++" > 1.1;
"+++" > 1.5; and
"++++" > 3.

Based on the results shown in Table 3-4, SEQ ID NO: 478 was chosen as the next backbone for evolution. Beneficial mutations identified based on the results shown in Table 3-4 were recombined into the backbone. Additionally, variants were also constructed on SEQ ID NO: 478, through saturation mutagenesis at different positions. The variants were assayed as described in Example 2. The only difference is that the heat challenge was performed at 72° C. instead of 61° C., and low pH challenge was performed at pH 4.8 instead of pH 5.2. The results are provided in Table 3-5. In this Table, the amino acid differences are indicated relative to SEQ ID NO: 478.

TABLE 3-5

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 563/564 | G124S/G368D | S11M/G55K/L69I/G124S/ Q165R/A173V/Y189L/ Q283H/N290A/Q304R/ A344T/H366E/G368D | +++ | | | |
| 565/566 | T8S/G368D | T8S/S11M/G55K/L69I/ Q165R/A173V/Y189L/ Q283H/N290A/Q304R/ A344T/H366E/G368D | ++ | + | +++ | + |
| 567/568 | N7V/G368D | N7V/S11M/G55K/L69I/ Q165R/A173V/Y189L/ Q283H/N290A/Q304R/ A344T/H366E/G368D | | | ++ | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 569/570 | N7E/G368D | N7E/S11M/G55K/L69I/ Q165R/A173V/Y189L/ Q283H/N290A/Q304R/ A344T/H366E/G368D | +++ | + | ++ | |
| 571/572 | G83S/G368D | S11M/G55K/L69I/G83S/ Q165R/A173V/Y189L/ Q283H/N290A/Q304R/ A344T/H366E/G368D | +++ | + | + | + |
| 573/574 | N5H/G368D | N5H/S11M/G55K/L69I/ Q165R/A173V/Y189L/ Q283H/N290A/Q304R/ A344T/H366E/G368D | ++ | ++ | +++ | |
| 575/576 | T66S/G368D | S11M/G55K/T66S/L69I/ Q165R/A173V/Y189L/ Q283H/N290A/Q304R/ A344T/H366E/G368D | + | | | |
| 577/578 | N5I/G368D | N5I/S11M/G55K/L69I/ Q165R/A173V/Y189L/ Q283H/N290A/Q304R/ A344T/H366E/G368D | + | ++ | + | + |
| 579/580 | P21A/G368D | S11M/P21A/G55K/L69I/ Q165R/A173V/Y189L/ Q283H/N290A/Q304R/ A344T/H366E/G368D | +++ | | +++ | + |
| 581/582 | T35S/G368D | S11M/T35S/G55K/L69I/ Q165R/A173V/Y189L/ Q283H/N290A/Q304R/ A344T/H366E/G368D | ++ | + | +++ | |
| 583/584 | G124V/G368D | S11M/G55K/L69I/G124V/ Q165R/A173V/Y189L/ Q283H/N290A/Q304R/ A344T/H366E/G368D | +++ | | ++ | |
| 585/586 | L67R/G368D | S11M/G55K/L67R/L69I/ Q165R/A173V/Y189L/ Q283H/N290A/Q304R/ A344T/H366E/G368D | ++ | +++ | | + |
| 587/588 | N7G/G368D | N7G/S11M/G55K/L69I/ Q165R/A173V/Y189L/ Q283H/N290A/Q304R/ A344T/H366E/G368D | ++ | ++ | ++ | |
| 589/590 | A48R/G368D | S11M/A48R/G55K/L69I/ Q165R/A173V/Y189L/ Q283H/N290A/Q304R/ A344T/H366E/G368D | ++ | + | ++ | |
| 591/592 | S4R/G368D | S4R/S11M/G55K/L69I/ Q165R/A173V/Y189L/ Q283H/N290A/Q304R/ A344T/H366E/G368D | + | +++ | +++ | |
| 593/594 | P31A/G368D | S11M/P31A/G55K/L69I/ Q165R/A173V/Y189L/ Q283H/N290A/Q304R/ A344T/H366E/G368D | ++ | | ++ | |
| 595/596 | G124A/G368D | S11M/G55K/L69I/G124A/ Q165R/A173V/Y189L/ Q283H/N290A/Q304R/ A344T/H366E/G368D | +++ | | +++ | + |
| 597/598 | A27S/G368D | S11M/A27S/G55K/L69I/ Q165R/A173V/Y189L/ Q283H/N290A/Q304R/ A344T/H366E/G368D | + | ++ | +++ | |
| 599/600 | T35G/G368D | S11M/T35G/G55K/L69I/ Q165R/A173V/Y189L/ Q283H/N290A/Q304R/ A344T/H366E/G368D | +++ | | | |
| 601/602 | L67Q/G368D | S11M/G55K/L67Q/L69I/ Q165R/A173V/Y189L/ Q283H/N290A/Q304R/ A344T/H366E/G368D | +++ | | ++ | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 603/604 | L67V/G368D | S11M/G55K/L67V/L69I/ Q165R/A173V/Y189L/ Q283H/N290A/Q304R/ A344T/H366E/G368D | +++ | | | |
| 605/606 | N5P/G368D | N5P/S11M/G55K/L69I/ Q165R/A173V/Y189L/ Q283H/N290A/Q304R/ A344T/H366E/G368D | + | ++ | | |
| 607/608 | L67A/G368D | S11M/G55K/L67A/L69I/ Q165R/A173V/Y189L/ Q283H/N290A/Q304R/ A344T/H366E/G368D | +++ | ++ | + | |
| 609/610 | Y33T/G368D/ | S11M/Y33T/G55K/L69I/ Q165R/A173V/Y189L/ Q283H/N290A/Q304R/ A344T/H366E/G368D | ++ | | | |
| 611/612 | T99A/G368D | S11M/G55K/L69I/T99A/ Q165R/A173V/Y189L/ Q283H/N290A/Q304R/ A344T/H366E/G368D | +++ | | +++ | |
| 613/614 | T8P/G368D | T8P/S11M/G55K/L69I/ Q165R/A173V/Y189L/ Q283H/N290A/Q304R/ A344T/H366E/G368D | ++ | +++ | +++ | ++ |
| 615/616 | D3A/H283N/ G368D | D3A/S11M/G55K/L69I/ Q165R/A173V/Y189L/ Q283N/N290A/Q304R/ A344T/H366E/G368D | | +++ | | ++ |
| 617/618 | V32N/G368D | S11M/V32N/G55K/L69I/ Q165R/A173V/Y189L/ Q283H/N290A/Q304R/ A344T/H366E/G368D | ++ | | | |
| 619/620 | D3S/G368D | D3S/S11M/G55K/L69I/ Q165R/A173V/Y189L/ Q283H/N290A/Q304R/ A344T/H366E/G368D | | ++ | | + |
| 621/622 | A119T/G368D | S11M/G55K/L69I/A119T/ Q165R/A173V/Y189L/ Q283H/N290A/Q304R/ A344T/H366E/G368D | | | +++ | + |
| 623/624 | P30N/G368D | S11M/P30N/G55K/L69I/ Q165R/A173V/Y189L/ Q283H/N290A/Q304R/ A344T/H366E/G368D | ++ | | | + |
| 625/626 | N5G/G368D | N5G/S11M/G55K/L69I/ Q165R/A173V/Y189L/ Q283H/N290A/Q304R/ A344T/H366E/G368D | ++ | ++ | ++ | |
| 627/628 | T8Y/G368D | T8Y/S11M/G55K/L69I/ Q165R/A173V/Y189L/ Q283H/N290A/Q304R/ A344T/H366E/G368D | ++ | +++ | | + |
| 629/630 | T66Q/G368D | S11M/G55K/T66Q/L69I/ Q165R/A173V/Y189L/ Q283H/N290A/Q304R/ A344T/H366E/G368D | ++ | | | |
| 631/632 | N7L/G368D | N7L/S11M/G55K/L69I/ Q165R/A173V/Y189L/ Q283H/N290A/Q304R/ A344T/H366E/G368D | + | + | + | |
| 633/634 | Y33A/G368D | S11M/Y33A/G55K/L69I/ Q165R/A173V/Y189L/ Q283H/N290A/Q304R/ A344T/H366E/G368D | ++ | | | + |
| 635/636 | G124R/S353T/ G368D | S11M/G55K/L69I/G124R/ Q165R/A173V/Y189L/ Q283H/N290A/Q304R/ A344T/S353T/H366E/G368D | + | | | + |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 637/638 | N7F/G368D | N7F/S11M/G55K/L69I/ Q165R/A173V/Y189L/ Q283H/N290A/Q304R/ A344T/H366E/G368D | + | ++ | + | ++ |
| 639/640 | T8R/G368D | T8R/S11M/G55K/L69I/ Q165R/A173V/Y189L/ Q283H/N290A/Q304R/ A344T/H366E/G368D | + | +++ | ++ | ++ |
| 641/642 | G46Q/G368D | S11M/G46Q/G55K/L69I/ Q165R/A173V/Y189L/ Q283H/N290A/Q304R/ A344T/H366E/G368D | +++ |  | +++ |  |
| 643/644 | D3P/G368D | D3P/S11M/G55K/L69I/ Q165R/A173V/Y189L/ Q283H/N290A/Q304R/ A344T/H366E/G368D | ++ | ++ | ++ | + |
| 645/646 | G124H/G368D | S11M/G55K/L69I/G124H/ Q165R/A173V/Y189L/ Q283H/N290A/Q304R/ A344T/H366E/G368D | ++ |  |  |  |
| 647/648 | A48M/G368D | S11M/A48M/G55K/L69I/ Q165R/A173V/Y189L/ Q283H/N290A/Q304R/ A344T/H366E/G368D | + |  | ++ |  |
| 649/650 | N5K/G368D | N5K/S11M/G55K/L69I/ Q165R/A173V/Y189L/ Q283H/N290A/Q304R/ A344T/H366E/G368D | +++ | +++ | ++ | + |
| 651/652 | I69R/G368D | S11M/G55K/L69R/Q165R/ A173V/Y189L/Q283H/ N290A/Q304R/A344T/ H366E/G368D | + | +++ | ++ |  |
| 653/654 | S4G/G368D | S4G/S11M/G55K/L69I/ Q165R/A173V/Y189L/ Q283H/N290A/Q304R/ A344T/H366E/G368D | +++ | ++ | +++ | + |
| 655/656 | G9A/G368D | G9A/S11M/G55K/L69I/ Q165R/A173V/Y189L/ Q283H/N290A/Q304R/ A344T/H366E/G368D |  | ++ |  |  |
| 657/658 | I231V/G368D | S11M/G55K/L69I/Q165R/ A173V/Y189L/I231V/ Q283H/N290A/Q304R/ A344T/H366E/G368D |  | +++ | +++ | + |
| 659/660 | S214C/G368D | S11M/G55K/L69I/Q165R/ A173V/Y189L/S214C/ Q283H/N290A/Q304R/ A344T/H366E/G368D | ++ | ++ | + | ++ |
| 661/662 | L181I/G368D | S11M/G55K/L69I/Q165R/ A173V/L181I/Y189L/ Q283H/N290A/Q304R/ A344T/H366E/G368D | ++ | +++ | +++ | ++ |
| 663/664 | A146S/G368D | S11M/G55K/L69I/A146S/ Q165R/A173V/Y189L/ Q283H/N290A/Q304R/ A344T/H366E/G368D |  |  | ++ |  |
| 665/666 | T243C/G368D | S11M/G55K/L69I/Q165R/ A173V/Y189L/T243C/ Q283H/N290A/Q304R/ A344T/H366E/G368D | ++ |  | ++ |  |
| 667/668 | T243G/G368D | S11M/G55K/L69I/Q165R/ A173V/Y189L/T243G/ Q283H/N290A/Q304R/ A344T/H366E/G368D | +++ |  |  |  |
| 669/670 | F128H/G368D | S11M/G55K/L69I/F128H/ Q165R/A173V/Y189L/ Q283H/N290A/Q304R/ A344T/H366E/G368D | +++ |  |  |  |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 671/672 | T176V/G368D | S11M/G55K/L69I/Q165R/ A173V/T176V/Y189L/ Q283H/N290A/Q304R/ A344T/H366E/G368D | + | +++ | + | + |
| 673/674 | D251A/G368D | S11M/G55K/L69I/Q165R/ A173V/Y189L/D251A/ Q283H/N290A/Q304R/ A344T/H366E/G368D | ++ | + | +++ | |
| 675/676 | V173A/G368D | S11M/G55K/L69I/Q165R/ Y189L/Q283H/N290A/ Q304R/A344T/H366E/ G368D | +++ | +++ | ++ | +++ |
| 677/678 | A245G/G368D | S11M/G55K/L69I/Q165R/ A173V/Y189L/A245G/ Q283H/N290A/Q304R/ A344T/H366E/G368D | ++ | ++ | ++++ | |
| 679/680 | R111H/Q195S/ G368D | S11M/G55K/L69I/R111H/ Q165R/A173V/Y189L/ Q195S/Q283H/N290A/ Q304R/A344T/H366E/ G368D | ++ | | +++ | |
| 681/682 | I154V/G368D | S11M/G55K/L69I/I154V/ Q165R/A173V/Y189L/ Q283H/N290A/Q304R/ A344T/H366E/G368D | | ++ | | |
| 683/684 | A245S/G368D | S11M/G55K/L69I/Q165R/ A173V/Y189L/A245S/ Q283H/N290A/Q304R/ A344T/H366E/G368D | +++ | ++ | ++ | ++ |
| 685/686 | Q195T/G368D | S11M/G55K/L69I/Q165R/ A173V/Y189L/Q195T/ Q283H/N290A/Q304R/ A344T/H366E/G368D | ++ | | + | |
| 687/688 | T243S/G368D | S11M/G55K/L69I/Q165R/ A173V/Y189L/T243S/ Q283H/N290A/Q304R/ A344T/H366E/G368D | +++ | | +++ | ++ |
| 689/690 | I183V/G368D | S11M/G55K/L69I/Q165R/ A173V/I183V/Y189L/ Q283H/N290A/Q304R/ A344T/H366E/G368D | ++ | ++ | ++ | + |
| 691/692 | L247M/G368D | S11M/G55K/L69I/Q165R/ A173V/Y189L/L247M/ Q283H/N290A/Q304R/ A344T/H366E/G368D | ++ | +++ | +++ | ++ |
| 693/694 | V225C/G368D | S11M/G55K/L69I/Q165R/ A173V/Y189L/V225C/ Q283H/N290A/Q304R/ A344T/H366E/G368D | | | +++ | |
| 695/696 | V167T/G368D | S11M/G55K/L69I/Q165R/ V167T/A173V/Y189L/ Q283H/N290A/Q304R/ A344T/H366E/G368D | + | | ++ | |
| 697/698 | F335I/G368D | S11M/G55K/L69I/Q165R/ A173V/Y189L/Q283H/ N290A/Q304R/F335I/ A344T/H366E/G368D | | | +++ | ++ |
| 699/700 | I259L/G368D | S11M/G55K/L69I/Q165R/ A173V/Y189L/I259L/ Q283H/N290A/Q304R/ A344T/H366E/G368D | ++ | ++ | +++ | |
| 701/702 | A263S/G368D | S11M/G55K/L69I/Q165R/ A173V/Y189L/A263S/ Q283H/N290A/Q304R/ A344T/H366E/G368D | + | + | ++ | + |
| 703/704 | A263G/G368D | S11M/G55K/L69I/Q165R/ A173V/Y189L/A263G/ Q283H/N290A/Q304R/ A344T/H366E/G368D | +++ | ++ | ++ | + |
| 705/706 | M242F/G368D | S11M/G55K/L69I/Q165R/ A173V/Y189L/M242F/ Q283H/N290A/Q304R/ A344T/H366E/G368D | | + | + | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 707/708 | G312A/G368D | S11M/G55K/L69I/Q165R/ A173V/Y189L/Q283H/ N290A/Q304R/G312A/ A344T/H366E/G368D | +++ | | ++ | + |
| 709/710 | G368D/I390L | S11M/G55K/L69I/Q165R/ A173V/Y189L/Q283H/ N290A/Q304R/A344T/ H366E/G368D/I390L | +++ | + | +++ | |
| 711/712 | G368D/L386I | S11M/G55K/L69I/Q165R/ A173V/Y189L/Q283H/ N290A/Q304R/A344T/ H366E/G368D/L386I | + | ++ | | |
| 713/714 | N272S/G368D | S11M/G55K/L69I/Q165R/ A173V/Y189L/N272S/ Q283H/N290A/Q304R/ A344T/H366E/G368D | ++ | ++ | +++ | + |
| 715/716 | T344A/G368D | S11M/G55K/L69I/Q165R/ A173V/Y189L/Q283H/ N290A/Q304R/A344T/H366E/ G368D | +++ | +++ | +++ | |
| 717/718 | M256V/G368D | S11M/G55K/L69I/Q165R/ A173V/Y189L/M256V/ Q283H/N290A/Q304R/ A344T/H366E/G368D | ++ | | | |
| 719/720 | T344R/G368D | S11M/G55K/L69I/Q165R/ A173V/Y189L/Q283H/ N290A/Q304R/A344R/ H366E/G368D | ++ | + | +++ | |
| 721/722 | | S11M/G55K/L69I/Q165R/ A173V/Y189L/Q283H/ N290A/Q304R/A344T/ H366E | +++ | | +++ | ++ |
| 723/724 | A315S/G368D | S11M/G55K/L69I/Q165R/ A173V/Y189L/Q283H/ N290A/Q304R/A315S/ A344T/H366E/G368D | +++ | ++ | +++ | |
| 725/726 | I314L/G368D | S11M/G55K/L69I/Q165R/ A173V/Y189L/Q283H/ N290A/Q304R/I314L/ A344T/H366E/G368D | ++ | | ++ | |
| 727/728 | C49T/G368D | S11M/C49T/G55K/L69I/ Q165R/A173V/Y189L/ Q283H/N290A/Q304R/ A344T/H366E/G368D | +++ | | +++ | |
| 729/730 | T344S/G368D | S11M/G55K/L69I/Q165R/ A173V/Y189L/Q283H/ N290A/Q304R/A344S/ H366E/G368D | ++ | + | +++ | |
| 731/732 | G325A/G368D | S11M/G55K/L69I/Q165R/ A173V/Y189L/Q283H/ N290A/Q304R/G325A/ A344T/H366E/G368D | ++ | | ++ | |
| 733/734 | A263Q/G368D | S11M/G55K/L69I/Q165R/ A173V/Y189L/A263Q/ Q283H/N290A/Q304R/ A344T/H366E/G368D | | | ++ | |
| 735/736 | T344G/G368D | S11M/G55K/L69I/Q165R/ A173V/Y189L/Q283H/ N290A/Q304R/A344G/ H366E/G368D | +++ | | | |
| 737/738 | C49A/G368D | S11M/C49A/G55K/L69I/ Q165R/A173V/Y189L/ Q283H/N290A/Q304R/ A344T/H366E/G368D | +++ | | +++ | |
| 739/740 | A263K/G368D | S11M/G55K/L69I/Q165R/ A173V/Y189L/A263K/ Q283H/N290A/Q304R/ A344T/H366E/G368D | + | | +++ | + |
| 741/742 | M256L/A298V/ G368D | S11M/G55K/L69I/Q165R/ A173V/Y189L/M256L/ Q283H/N290A/A298V/ Q304R/A344T/H366E/ G368D | | ++ | ++ | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 743/744 | H269S/G368D | S11M/G55K/L69I/Q165R/ A173V/Y189L/H269S/ Q283H/N290A/Q304R/ A344T/H366E/G368D | | ++ | ++ | |
| 745/746 | A36S/G368D | S11M/A36S/G55K/L69I/ Q165R/A173V/Y189L/ Q283H/N290A/Q304R/ A344T/H366E/G368D | ++ | ++ | ++ | |
| 747/748 | L239T/G368D | S11M/G55K/L69I/Q165R/ A173V/Y189L/L239T/ Q283H/N290A/Q304R/ A344T/H366E/G368D | +++ | | ++ | |
| 749/750 | I62C/G368D | S11M/G55K/I62C/L69I/ Q165R/A173V/Y189L/ Q283H/N290A/Q304R/ A344T/H366E/G368D | +++ | | +++ | |
| 751/752 | S60T/G368D | S11M/G55K/S60T/L69I/ Q165R/A173V/Y189L/ Q283H/N290A/Q304R/ A344T/H366E/G368D | + | ++ | + | |
| 753/754 | L239V/G368D | S11M/G55K/L69I/Q165R/ A173V/Y189L/L239V/ Q283H/N290A/Q304R/ A344T/H366E/G368D | +++ | + | | |
| 755/756 | I219L/G368D | S11M/G55K/L69I/Q165R/ A173V/Y189L/I219L/ Q283H/N290A/Q304R/ A344T/H366E/G368D | + | ++ | | + |
| 757/758 | C190L/G368D | S11M/G55K/L69I/Q165R/ A173V/Y189L/C190L/ Q283H/N290A/Q304R/ A344T/H366E/G368D | ++ | | +++ | |
| 759/760 | G91S/G368D | S11M/G55K/L69I/G91S/ Q165R/A173V/Y189L/ Q283H/N290A/Q304R/ A344T/H366E/G368D | +++ | | | |
| 761/762 | C190G/G368D | S11M/G55K/L69I/Q165R/ A173V/Y189L/C190G/ Q283H/N290A/Q304R/ A344T/H366E/G368D | +++ | ++ | + | |
| 763/764 | I219V/G368D | S11M/G55K/L69I/Q165R/ A173V/Y189L/I219V/ Q283H/N290A/Q304R/ A344T/H366E/G368D | ++ | ++ | +++ | |
| 765/766 | L113T/G368D | S11M/G55K/L69I/L113T/ Q165R/A173V/Y189L/ Q283H/N290A/Q304R/ A344T/H366E/G368D | +++ | | + | |
| 767/768 | A209G/G368D | S11M/G55K/L69I/Q165R/ A173V/Y189L/A209G/ Q283H/N290A/Q304R/ A344T/H366E/G368D | +++ | | ++ | |
| 769/770 | I62A/G368D | S11M/G55K/I62A/L69I/ Q165R/A173V/Y189L/ Q283H/N290A/Q304R/ A344T/H366E/G368D | ++ | | ++ | |
| 771/772 | A221G/G368D | S11M/G55K/L69I/Q165R/ A173V/Y189L/A221G/ Q283H/N290A/Q304R/ A344T/H366E/G368D | | | +++ | |
| 773/774 | V206I/G368D | S11M/G55K/L69I/Q165R/ A173V/Y189L/V206I/ Q283H/N290A/Q304R/ A344T/H366E/G368D | +++ | ++ | +++ | + |
| 775/776 | L239Y/G368D | S11M/G55K/L69I/Q165R/ A173V/Y189L/L239Y/ Q283H/N290A/Q304R/ A344T/H366E/G368D | + | ++ | ++ | + |
| 777/778 | L113M/G368D | S11M/G55K/L69I/L113M/ Q165R/A173V/Y189L/ Q283H/N290A/Q304R/ A344T/H366E/G368D | +++ | | +++ | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 779/780 | I62H/G368D | S11M/G55K/I62H/L69I/Q165R/A173V/Y189L/Q283H/N290A/Q304R/A344T/H366E/G368D | ++ | +++ | +++ | ++ |
| 781/782 | T158S/G368D | S11M/G55K/L69I/T158S/Q165R/A173V/Y189L/Q283H/N290A/Q304R/A344T/H366E/G368D | ++ | ++ | | + |
| 783/784 | F156L/G368D | S11M/G55K/L69I/F156L/Q165R/A173V/Y189L/Q283H/N290A/Q304R/A344T/H366E/G368D | + | | +++ | |
| 785/786 | L239C/G368D | S11M/G55K/L69I/Q165R/A173V/Y189L/L239C/Q283H/N290A/Q304R/A344T/H366E/G368D | ++ | | +++ | |
| 787/788 | A160M/G368D | S11M/G55K/L69I/A160M/Q165R/A173V/Y189L/Q283H/N290A/Q304R/A344T/H366E/G368D | +++ | ++ | +++ | |
| 789/790 | A338G/G368D | S11M/G55K/L69I/Q165R/A173V/Y189L/Q283H/N290A/Q304R/A338G/A344T/H366E/G368D | + | + | ++ | |
| 791/792 | Q333S/L334V/G368D | S11M/G55K/L69I/Q165R/A173V/Y189L/Q283H/N290A/Q304R/Q333S/L334V/A344T/H366E/G368D | ++ | +++ | | |
| 793/794 | A290Q/G368D | S11M/G55K/L69I/Q165R/A173V/Y189L/Q283H/N290Q/Q304R/A344T/H366E/G368D | +++ | +++ | | |
| 795/796 | E53L/E54Q/K55H/A290V/G368D | S11M/E53L/E54Q/G55H/L69I/Q165R/A173V/Y189L/Q283H/N290V/Q304R/A344T/H366E/G368D | | ++ | | |
| 797/798 | E53L/E54Q/Q275N/H279F/L334V/S336H/G368D | S11M/E53L/E54Q/G55K/L69I/Q165R/A173V/Y189L/Q275N/H279F/Q283H/N290A/Q304R/L334V/S336H/A344T/H366E/G368D | | +++ | | |
| 799/800 | E53L/G368D | S11M/E53L/G55K/L69I/Q165R/A173V/Y189L/Q283H/N290A/Q304R/A344T/H366E/G368D | ++ | +++ | | |
| 801/802 | E54Q/L236Y/G368D | S11M/E54Q/G55K/L69I/Q165R/A173V/Y189L/L236Y/Q283H/N290A/Q304R/A344T/H366E/G368D | +++ | + | | |
| 803/804 | H179A/H279F/G368D | S11M/G55K/L69I/Q165R/A173V/H179A/Y189L/H279F/Q283H/N290A/Q304R/A344T/H366E/G368D | ++ | +++ | | |
| 805/806 | L236Y/G368D | S11M/G55K/L69I/Q165R/A173V/Y189L/L236Y/Q283H/N290A/Q304R/A344T/H366E/G368D | +++ | +++ | | |
| 807/808 | E53L/E54Q/A290V/G368D | S11M/E53L/E54Q/G55K/L69I/Q165R/A173V/Y189L/Q283H/N290V/Q304R/A344T/H366E/G368D | | +++ | | |
| 809/810 | E54Q/K55H/L236Y/H279F/A290Q/L334V/G368D/Q392H | S11M/E54Q/G55H/L69I/Q165R/A173V/Y189L/L236Y/H279F/Q283H/N290Q/Q304R/L334V/A344T/H366E/G368D/Q392H | +++ | | | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 811/812 | G368D | S11M/G55K/L69I/Q165R/ A173V/Y189L/Q283H/ N290A/Q304R/A344T/ H366E/G368D | +++ | +++ | | |
| 813/814 | A290V/L334V/ S336H/G368D | S11M/G55K/L69I/Q165R/ A173V/Y189L/Q283H/ N290V/Q304R/L334V/ S336H/A344T/H366E/ G368D | | +++ | | |
| 815/816 | K55H/L236Y/ A290Q/G368D | S11M/G55H/L69I/Q165R/ A173V/Y189L/L236Y/ Q283H/N290Q/Q304R/ A344T/H366E/G368D | +++ | + | | |
| 817/818 | E53L/E54Q/ G368D | S11M/E53L/E54Q/G55K/ L69I/Q165R/A173V/Y189L/ Q283H/N290A/Q304R/ A344T/H366E/G368D | ++ | ++ | | |
| 819/820 | L236Y/H279F/ G368D | S11M/G55K/L69I/Q165R/ A173V/Y189L/L236Y/ H279F/Q283H/N290A/ Q304R/A344T/H366E/ G368D | +++ | ++ | | |
| 821/822 | E54Q/A290V/ G368D | S11M/E54Q/G55K/L69I/ Q165R/A173V/Y189L/ Q283H/N290V/Q304R/ A344T/H366E/G368D | + | +++ | | |
| 823/824 | H279F/G368D | S11M/G55K/L69I/Q165R/ A173V/Y189L/H279F/ Q283H/N290A/Q304R/ A344T/H366E/G368D | +++ | +++ | | |
| 825/826 | G368D/Q392H | S11M/G55K/L69I/Q165R/ A173V/Y189L/Q283H/ N290A/Q304R/A344T/ H366E/G368D/Q392H | ++ | +++ | | |
| 827/828 | E53L/E54Q/ Q275H/A290V/ G368D | S11M/E53L/E54Q/G55K/ L69I/Q165R/A173V/ Y189L/Q275H/Q283H/ N290V/Q304R/A344T/ H366E/G368D | | +++ | | |
| 829/830 | E54Q/H179A/ G368D | S11M/E54Q/G55K/L69I/ Q165R/A173V/H179A/ Y189L/Q283H/N290A/ Q304R/A344T/H366E/ G368D | | ++ | | |
| 831/832 | A290Q/L334V/ G368D | S11M/G55K/L69I/Q165R/ A173V/Y189L/Q283H/ N290Q/Q304R/L334V/ A344T/H366E/G368D | +++ | | | +++ |
| 833/834 | L334V/G368D | S11M/G55K/L69I/Q165R/ A173V/Y189L/Q283H/ N290A/Q304R/L334V/ A344T/H366E/G368D | ++ | | | +++ |
| 835/836 | A290Q/I322K/ L334V/G368D/ Q392H | S11M/G55K/L69I/Q165R/ A173V/Y189L/Q283H/ N290Q/Q304R/I322K/ L334V/A344T/H366E/ G368D/Q392H | +++ | | | +++ |
| 837/838 | A290Q/I322K/ L334V/G368D | S11M/G55K/L69I/Q165R/ A173V/Y189L/Q283H/ N290Q/Q304R/I322K/ L334V/A344T/H366E/ G368D | +++ | | | +++ |
| 839/840 | A290Q/L334V/ G368D/Q392H | S11M/G55K/L69I/Q165R/ A173V/Y189L/Q283H/ N290Q/Q304R/L334V/ A344T/H366E/G368D/ Q392H | +++ | | | ++ |
| 841/842 | E53L/E54Q/ K55H/A290Q/ L334V/G368D | S11M/E53L/E54Q/G55H/ L69I/Q165R/A173V/Y189L/ Q283H/N290Q/Q304R/ L334V/A344T/H366E/ G368D | +++ | | | |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 843/844 | E54Q/K55H/ A290Q/G368D | S11M/E54Q/G55H/L69I/ Q165R/A173V/Y189L/ Q283H/N290Q/Q304R/ A344T/H366E/G368D | +++ | | | |
| 845/846 | R2S/K55E/ A290Q/L334V/ G368D | R2S/S11M/G55E/L69I/ Q165R/A173V/Y189L/ Q283H/N290Q/Q304R/ L334V/A344T/H366E/ G368D | +++ | | | + |
| 847/848 | R2S/A271D/ A290Q/I322K/ G368D | R2S/S11M/G55K/L69I/ Q165R/A173V/Y189L/ A271D/Q283H/N290Q/ Q304R/I322K/A344T/ H366E/G368D | +++ | | | +++ |
| 849/850 | A290Q/G368D | S11M/G55K/L69I/Q165R/ A173V/Y189L/Q283H/ N290Q/Q304R/A344T/ H366E/G368D | +++ | | | ++ |
| 851/852 | G368D/A388R | S11M/G55K/L69I/Q165R/ A173V/Y189L/Q283H/ N290A/Q304R/A344T/ H366E/G368D/A388R | ++ | | | + |
| 853/854 | G368D/D391N | S11M/G55K/L69I/Q165R/ A173V/Y189L/Q283H/ N290A/Q304R/A344T/ H366E/G368D/D391N | ++ | | | + |
| 855/856 | G368D | S11M/G55K/L69I/Q165R/ A173V/Y189L/Q283H/ N290A/Q304R/A344T/ H366E/G368D | ++ | | | ++ |
| 857/858 | L309A/G368D | S11M/G55K/L69I/Q165R/ A173V/Y189L/Q283H/ N290A/Q304R/L309A/ A344T/H366E/G368D | ++ | | | ++ |
| 859/860 | K240R/G368D/ A388R/Q392H | S11M/G55K/L69I/Q165R/ A173V/Y189L/K240R/ Q283H/N290A/Q304R/ A344T/H366E/G368D/ A388R/Q392H | | | | ++ |
| 861/862 | K55H/K240R/ G368D | S11M/G55H/L69I/Q165R/ A173V/Y189L/K240R/ Q283H/N290A/Q304R/ A344T/H366E/G368D | | + | | +++ |
| 863/864 | E54Q/K240R/ A388R | S11M/E54Q/G55K/L69I/ Q165R/A173V/Y189L/ K240R/Q283H/N290A/ Q304R/A344T/H366E/ A388R | | | | +++ |
| 865/866 | K240R/H367A | S11M/G55K/L69I/Q165R/ A173V/Y189L/K240R/ Q283H/N290A/Q304R/ A344T/H366E/H367A | | | | +++ |
| 867/868 | K240R/I322K | S11M/G55K/L69I/Q165R/ A173V/Y189L/K240R/ Q283H/N290A/Q304R/ I322K/A344T/H366E | | | | +++ |
| 869/870 | | S11M/G55K/L69I/Q165R/ A173V/Y189L/Q283H/ N290A/Q304R/A344T/ H366E | +++ | | | ++ |
| 871/872 | L334V/G368D/ A388R | S11M/G55K/L69I/Q165R/ A173V/Y189L/Q283H/ N290A/Q304R/L334V/ A344T/H366E/G368D/ A388R | ++ | ++ | | +++ |
| 873/874 | K240R/L334V/ Q392H | S11M/G55K/L69I/Q165R/ A173V/Y189L/K240R/ Q283H/N290A/Q304R/ L334V/A344T/H366E/ Q392H | | | | +++ |

TABLE 3-5-continued

Methionine Gamma Lyase Activity (Relative to SEQ ID NO: 478)[1]

| SEQ ID NO: (nt/aa) | Amino Acid Differences (Relative to SEQ ID NO: 478) | Amino Acid Differences (Relative to SEQ ID NO: 2) | FIOP Low Met | FIOP 72° C. | FIOP pH 4 | FIOP protease |
|---|---|---|---|---|---|---|
| 875/876 | E53L/K240R/L334V | S11M/E53L/G55K/L69I/Q165R/A173V/Y189L/K240R/Q283H/N290A/Q304R/L334V/A344T/H366E | | | | +++ |
| 877/878 | E53L/E54Q/K240R/L334V/G368D | S11M/E53L/E54Q/G55K/L69I/Q165R/A173V/Y189L/K240R/Q283H/N290A/Q304R/L334V/A344T/H366E/G368D | | ++ | | ++ |

[1] Levels of increased activity were determined relative to the reference polypeptide of SEQ ID NO: 478, and defined as follows:
"+" > 0.9;
"++" > 1.1;
"+++" > 1.5; and
"++++" > 3.

Based on the results shown in Table 3-5, SEQ ID NO: 832 was chosen as the next backbone for evolution. Beneficial mutations identified based on the results shown in Table 3-5 were recombined into the backbone. The variants were assayed as described in Example 2. The only differences were that the heat challenge was performed at 65° C. instead of 68° C., and low pH challenge was performed at pH 5 instead of pH 5.2. The results are provided in Table 3-6. In this Table, the amino acid differences are indicated relative to SEQ ID NO: 832.

TABLE 3-6

Methionine Gamma Lyase Activity (Relative to SEQ ID NO: 832)[1]

| SEQ ID NO: (nt/aa) | Amino Acid Differences (Relative to SEQ ID NO: 832) | Amino Acid Differences (Relative to SEQ ID NO: 2) | FIOP 65 °C./Low Met | FIOP 65° C./pH 4 | FIOP 65° C./protease |
|---|---|---|---|---|---|
| 879/880 | H279F | S11M/G55K/L69I/Q165R/A173V/Y189L/H279F/Q283H/N290Q/Q304R/L334V/A344T/H366E/G368D | + | | ++ |
| 881/882 | E127Q/H279F/I322K | S11M/G55K/L69I/E127Q/Q165R/A173V/Y189L/H279F/Q283H/N290Q/Q304R/I322K/L334V/A344T/H366E/G368D | | + | ++ |
| 883/884 | V206I | S11M/G55K/L69I/Q165R/A173V/Y189L/V206I/Q283H/N290Q/Q304R/L334V/A344T/H366E/G368D | | ++ | |
| 885/886 | I322K/D368G | S11M/G55K/L69I/Q165R/A173V/Y189L/Q283H/N290Q/Q304R/I322K/L334V/A344T/H366E | | | + |
| 887/888 | H279F/D368G | S11M/G55K/L69I/Q165R/A173V/Y189L/H279F/Q283H/N290Q/Q304R/L334V/A344T/H366E | + | | |
| 889/890 | I322K | S11M/G55K/L69I/Q165R/A173V/Y189L/Q283H/N290Q/Q304R/I322K/L334V/A344T/H366E/G368D | | + | + |
| 891/892 | A263G | S11M/G55K/L69I/Q165R/A173V/Y189L/A263G/Q283H/N290Q/Q304R/L334V/A344T/H366E/G368D | ++ | | + |
| 893/894 | N272S/V334L/D368G | S11M/G55K/L69I/Q165R/A173V/Y189L/N272S/Q283H/N290Q/Q304R/A344T/H366E | ++ | | |
| 895/896 | V334L | S11M/G55K/L69I/Q165R/A173V/Y189L/Q283H/N290Q/Q304R/A344T/H366E/G368D | ++ | + | + |
| 897/898 | I219V/V334L/D368G | S11M/G55K/L69I/Q165R/A173V/Y189L/I219V/Q283H/N290Q/Q304R/A344T/H366E | ++ | | |
| 899/900 | A263G/V334L | S11M/G55K/L69I/Q165R/A173V/Y189L/A263G/Q283H/N290Q/Q304R/A344T/H366E/G368D | ++ | | + |
| 901/902 | V334L/D368G | S11M/G55K/L69I/Q165R/A173V/Y189L/Q283H/N290Q/Q304R/A344T/H366E | ++ | | |

TABLE 3-6-continued

Methionine Gamma Lyase Activity (Relative to SEQ ID NO: 832)[1]

| SEQ ID NO: (nt/aa) | Amino Acid Differences (Relative to SEQ ID NO: 832) | Amino Acid Differences (Relative to SEQ ID NO: 2) | FIOP 65 °C./ Low Met | FIOP 65° C./ pH 4 | FIOP 65° C./ protease |
|---|---|---|---|---|---|
| 903/904 | C190G | S11M/G55K/L69I/Q165R/A173V/ Y189L/C190G/Q283H/N290Q/Q304R/ L334V/A344T/H366E/G368D | ++ | | |
| 905/906 | T8S/G83S/I219V/ K240R/V334L/ D368G | T8S/S11M/G55K/L69I/G83S/Q165R/ A173V/Y189L/I219V/K240R/ Q283H/N290Q/Q304R/A344T/H366E | ++ | | ++ |
| 907/908 | I219V | S11M/G55K/L69I/Q165R/A173V/ Y189L/I219V/Q283H/N290Q/Q304R/ L334V/A344T/H366E/G368D | ++ | ++ | |
| 909/910 | A119T/A315S/ V334L/D368G | S11M/G55K/L69I/A119T/Q165R/ A173V/Y189L/Q283H/N290Q/ Q304R/A315S/A344T/H366E | ++ | | |
| 911/912 | T8S | T8S/S11M/G55K/L69I/Q165R/A173V/ Y189L/Q283H/N290Q/Q304R/ L334V/A344T/H366E/G368D | + | + | + |
| 913/914 | T8S/I219V/N272S | T8S/S11M/G55K/L69I/Q165R/A173V/ Y189L/I219V/N272S/Q283H/ N290Q/Q304R/L334V/A344T/H366E/ G368D | + | ++ | |
| 915/916 | I219V/A263G/ V334L | S11M/G55K/L69I/Q165R/A173V/ Y189L/I219V/A263G/Q283H/N290Q/ Q304R/A344T/H366E/G368D | ++ | ++ | |
| 917/918 | G83S | S11M/G55K/L69I/G83S/Q165R/ A173V/Y189L/Q283H/N290Q/Q304R/ L334V/A344T/H366E/G368D | + | + | |
| 919/920 | D3P/T8S | D3P/T8S/S11M/G55K/L69I/Q165R/ A173V/Y189L/Q283H/N290Q/ Q304R/L334V/A344T/H366E/G368D | + | | ++ |
| 921/922 | A315S/V334L | S11M/G55K/L69I/Q165R/A173V/ Y189L/Q283H/N290Q/Q304R/A315S/ A344T/H366E/G368D | ++ | + | |
| 923/924 | D368G | S11M/G55K/L69I/Q165R/A173V/ Y189L/Q283H/N290Q/Q304R/ L334V/A344T/H366E | ++ | | |
| 925/926 | N272S | S11M/G55K/L69I/Q165R/A173V/ Y189L/N272S/Q283H/N290Q/Q304R/ L334V/A344T/H366E/G368D | + | ++ | ++ |
| 927/928 | V173A | S11M/G55K/L69I/Q165R/Y189L/ Q283H/N290Q/Q304R/L334V/ A344T/H366E/G368D | + | + | ++ |

Levels of increased activity were determined relative to the reference polypeptide of SEQ ID NO: 832, and defined as follows:
"+" > 0.9;
"++" > 1.1;
"+++" > 1.5; and
"++++" > 3.

Based on the results shown in Table 3-6, SEQ ID NO: 916 was chosen as the next backbone for evolution. Beneficial mutations identified based on the results shown in Table 3-6 were recombined into the backbone. Additionally, variants were also constructed on SEQ ID NO: 916, through saturation mutagenesis at different positions. The variants were assayed as described in Example 2. The only difference was that the low pH challenge was performed at pH 4.2 instead of pH 5.2. The results are provided in Table 3-7. In this Table, the amino acid differences are indicated relative to SEQ ID NO: 916.

TABLE 3-7

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FiOP 65° C./ pH 4 | FIOP 65° C./ protease |
|---|---|---|---|---|---|
| 929/930 | L223I | S11M/G55K/L69I/Q165R/A173V/ Y189L/I219V/L223I/A263G/Q283H/ N290Q/Q304R/A344T/H366E/G368D | ++ | ++ | ++ |
| 931/932 | F316L | S11M/G55K/L69I/Q165R/A173V/ Y189L/I219V/A263G/Q283H/N290Q/ Q304R/F316L/A344T/H366E/G368D | ++ | + | ++++ |

TABLE 3-7-continued

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FIOP 65° C./ pH 4 | FIOP 65° C./ protease |
|---|---|---|---|---|---|
| 933/934 | A315S | S11M/G55K/L69I/Q165R/A173V/ Y189L/I219V/A263G/Q283H/N290Q/ Q304R/A315S/A344T/H366E/G368D | ++ | | |
| 935/936 | L255V | S11M/G55K/L69I/Q165R/A173V/ Y189L/I219V/L255V/A263G/Q283H/ N290Q/Q304R/A344T/H366E/G368D | ++ | +++ | +++ |
| 937/938 | C190A | S11M/G55K/L69I/Q165R/A173V/ Y189L/C190A/I219V/A263G/Q283H/ N290Q/Q304R/A344T/H366E/G368D | +++ | + | |
| 939/940 | L239K | S11M/G55K/L69I/Q165R/A173V/ Y189L/I219V/L239K/A263G/Q283H/ N290Q/Q304R/A344T/H366E/G368D | ++ | ++ | ++++ |
| 941/942 | V219L | S11M/G55K/L69I/Q165R/A173V/ Y189L/I219L/A263G/Q283H/N290Q/ Q304R/A344T/H366E/G368D | ++ | ++ | +++ |
| 943/944 | A252C | S11M/G55K/L69I/Q165R/A173V/ Y189L/I219V/A252C/A263G/Q283H/ N290Q/Q304R/A344T/H366E/G368D | + | ++ | |
| 945/946 | L189I | S11M/G55K/L69I/Q165R/A173V/ Y189I/I219V/A263G/Q283H/N290Q/ Q304R/A344T/H366E/G368D | + | +++ | |
| 947/948 | C270S | S11M/G55K/L69I/Q165R/A173V/ Y189L/I219V/A263G/C270S/Q283H/ N290Q/Q304R/A344T/H366E/G368D | + | +++ | + |
| 949/950 | V276I | S11M/G55K/L69I/Q165R/A173V/ Y189L/I219V/A263G/V276I/Q283H/ N290Q/Q304R/A344T/H366E/G368D | ++ | +++ | + |
| 951/952 | M256L | S11M/G55K/L69I/Q165R/A173V/ Y189L/I219V/M256L/A263G/Q283H/ N290Q/Q304R/A344T/H366E/G368D | ++ | +++ | |
| 953/954 | A324S | S11M/G55K/L69I/Q165R/A173V/ Y189L/I219V/A263G/Q283H/N290Q/ Q304R/A324S/A344T/H366E/G368D | ++ | +++ | ++ |
| 955/956 | L341F | S11M/G55K/L69I/Q165R/A173V/ Y189L/I219V/A263G/Q283H/N290Q/ Q304R/L341F/A344T/H366E/G368D | ++ | +++ | +++ |
| 957/958 | V276L | S11M/G55K/L69I/Q165R/A173V/ Y189L/I219V/A263G/V276L/Q283H/ N290Q/Q304R/A344T/H366E/G368D | ++ | +++ | |
| 959/960 | Q141G | S11M/G55K/L69I/Q141G/Q165R/ A173V/Y189L/I219V/A263G/Q283H/ N290Q/Q304R/A344T/H366E/G368D | ++ | + | |
| 961/962 | F335I | S11M/G55K/L69I/Q165R/A173V/ Y189L/I219V/A263G/Q283H/N290Q/ Q304R/F335I/A344T/H366E/G368D | ++ | +++ | +++ |
| 963/964 | N6R | N6R/S11M/G55K/L69I/Q165R/A173V/ Y189L/I219V/A263G/Q283H/N290Q/ Q304R/A344T/H366E/G368D | + | ++ | |
| 965/966 | A365K | S11M/G55K/L69I/Q165R/A173V/ Y189L/I219V/A263G/Q283H/N290Q/ Q304R/A344T/A365K/H366E/G368D | ++ | ++ | + |
| 967/968 | A298K | S11M/G55K/L69I/Q165R/A173V/ Y189L/I219V/A263G/Q283H/N290Q/ A298K/Q304R/A344T/H366E/G368D | + | + | +++ |
| 969/970 | E323T | S11M/G55K/L69I/Q165R/A173V/ Y189L/I219V/A263G/Q283H/N290Q/ Q304R/E323T/A344T/H366E/G368D | + | + | ++ |
| 971/972 | D384S | S11M/G55K/L69I/Q165R/A173V/ Y189L/I219V/A263G/Q283H/N290Q/ Q304R/A344T/H366E/G368D/D384S | + | ++ | |
| 973/974 | R282V | S11M/G55K/L69I/Q165R/A173V/ Y189L/I219V/A263G/R282V/Q283H/ N290Q/Q304R/A344T/H366E/G368D | + | ++ | |
| 975/976 | L288T | S11M/G55K/L69I/Q165R/A173V/ Y189L/I219V/A263G/Q283H/L288T/ N290Q/Q304R/A344T/H366E/G368D | ++ | ++ | |
| 977/978 | E323K | S11M/G55K/L69I/Q165R/A173V/ Y189L/I219V/A263G/Q283H/N290Q/ Q304R/E323K/A344T/H366E/G368D | + | + | ++ |

TABLE 3-7-continued

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FIOP 65° C./ pH 4 | FIOP 65° C./ protease |
|---|---|---|---|---|---|
| 979/980 | S23K | S11M/S23K/G55K/L69I/Q165R/A173V/ Y189L/I219V/A263G/Q283H/N290Q/ Q304R/A344T/H366E/G368D | + | ++ | +++ |
| 981/982 | A301K | S11M/G55K/L69I/Q165R/A173V/ Y189L/I219V/A263G/Q283H/N290Q/ A301K/Q304R/A344T/H366E/G368D | ++ | ++ | ++ |
| 983/984 | L288A | S11M/G55K/L69I/Q165R/A173V/ Y189L/I219V/A263G/Q283H/L288A/ N290Q/Q304R/A344T/H366E/G368D | ++ | +++ | |
| 985/986 | P284S | S11M/G55K/L69I/Q165R/A173V/ Y189L/I219V/A263G/Q283H/P284S/ N290Q/Q304R/A344T/H366E/G368D | + | ++ | |
| 987/988 | N6L | N6L/S11M/G55K/L69I/Q165R/A173V/ Y189L/I219V/A263G/Q283H/N290Q/ Q304R/A344T/H366E/G368D | ++ | + | |
| 989/990 | K144R | S11M/G55K/L69I/K144R/Q165R/ A173V/Y189L/I219V/A263G/Q283H/ N290Q/Q304R/A344T/H366E/G368D | ++ | ++ | + |
| 991/992 | P149T | S11M/G55K/L69I/P149T/Q165R/ A173V/Y189L/I219V/A263G/Q283H/ N290Q/Q304R/A344T/H366E/G368D | + | ++ | |
| 993/994 | N6S | N6S/S11M/G55K/L69I/Q165R/A173V/ Y189L/I219V/A263G/Q283H/N290Q/ Q304R/A344T/H366E/G368D | ++ | ++ | |
| 995/996 | Q362R | S11M/G55K/L69I/Q165R/A173V/ Y189L/I219V/A263G/Q283H/N290Q/ Q304R/A344T/Q362R/H366E/G368D | ++ | | |
| 997/998 | A51S | S11M/A51S/G55K/L69I/Q165R/ A173V/Y189L/I219V/A263G/Q283H/ N290Q/Q304R/A344T/H366E/G368D | ++ | ++ | |
| 999/1000 | R282N | S11M/G55K/L69I/Q165R/A173V/ Y189L/I219V/A263G/R282N/Q283H/ N290Q/Q304R/A344T/H366E/G36D8 | ++ | + | |
| 1001/1002 | A51N | S11M/A51N/G55K/L69I/Q165R/ A173V/Y189L/I219V/A263G/Q283H/ N290Q/Q304R/A344T/H366E/G368D | ++ | + | |
| 1003/1004 | L288W | S11M/G55K/L69I/Q165R/A173V/ Y189L/I219V/A263G/Q283H/L288W/ N290Q/Q304R/A344T/H366E/G368D | ++ | +++ | |
| 1005/1006 | K228R | S11M/G55K/L69I/Q165R/A173V/ Y189L/I219V/K228R/A263G/Q283H/ N290Q/Q304R/A344T/H366E/G368D | + | ++ | |
| 1007/1008 | A298S | S11M/G55K/L69I/Q165R/A173V/ Y189L/I219V/A263G/Q283H/N290Q/ A298S/Q304R/A344T/H366E/G368D | ++ | ++ | ++ |
| 1009/1010 | L288G | S11M/G55K/L69I/Q165R/A173V/ Y189L/I219V/A263G/Q283H/L288G/ N290Q/Q304R/A344T/H366E/G368D | ++ | ++ | |
| 1011/1012 | A298G | S11M/G55K/L69I/Q165R/A173V/ Y189L/I219V/A263G/Q283H/N290Q/ A298G/Q304R/A344T/H366E/G368D | + | ++ | + |
| 1013/1014 | A301E | S11M/G55K/L69I/Q165R/A173V/ Y189L/I219V/A263G/Q283H/N290Q/ A301E/Q304R/A344T/H366E/G368D | ++ | | |
| 1015/1016 | Q141P | S11M/G55K/L69I/Q141P/Q165R/ A173V/Y189L/I219V/A263G/Q283H/ 2N90Q/Q304R/A344T/H366E/G368D | ++ | ++ | ++ |
| 1017/1018 | A298P | S11M/G55K/L69I/Q165R/A173V/ Y189L/I219V/A263G/Q283H/N290Q/ A298P/Q304R/A3D44T/H366E/G368 | + | ++ | + |
| 1019/1020 | Q141T | S11M/G55K/L69I/Q141T/Q165R/ A173V/Y189L/I219V/A263G/Q283H/ N290Q/Q304R/A344T/H366E/G38D | ++ | ++ | +++ |
| 1021/1022 | L288I | S11M/G55K/L69I/Q165R/A173V/ Y189L/I219V/A263G/Q283H/L288I/ N290Q/Q304R/A344T/H366E/G368D | + | ++ | ++ |
| 1023/1024 | E127A | S11M/G55K/L69I/E127A/Q165R/ A173V/Y189L/I219V/A263G/Q283H/ N290Q/Q304R/A344T/H366E/G368D | ++ | | |

TABLE 3-7-continued

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FIOP 65° C./ pH 4 | FIOP 65° C./ protease |
|---|---|---|---|---|---|
| 1025/1026 | A229S | S11M/G55K/L69I/Q165R/A173V/ Y189L/I219V/A229S/A263G/Q283H/ N290Q/Q304R/A344T/H366E/G36D8 | ++ | +++ | + |
| 1027/1028 | A396V | S11M/G55K/L69I/Q165R/A173V/ Y189L/I219V/A263G/Q283H/N290Q/ Q304R/A344T/H366E/G368D/A39V6 | + | | +++ |
| 1029/1030 | K395R | S11M/G55K/L69I/Q165R/A173V/ Y189L/I219V/A263G/Q283H/N290Q/ Q304R/A344T/H366E/G368D/K395R | ++ | | + |
| 1031/1032 | R282A | S11M/G55K/L69I/Q165R/A173V/ Y189L/I219V/A263G/R282A/Q283H/ N290Q/Q304R/A344T/H366E/G368D | ++ | ++ | +++ |
| 1033/1034 | L288R | S11M/G55K/L69I/Q165R/A173V/ Y189L/I219V/A263G/Q283H/L288R/ N290Q/Q304R/A344T/H366E/G368D | ++ | +++ | |
| 1035/1036 | A51K | S11M/A51K/G55K/L69I/Q165R/ A173V/Y189L/I219V/A263G/Q283H/ N290Q/Q304R/A344T/H366E/G368D | ++ | + | |
| 1037/1038 | L288S | S11M/G55K/L69I/Q165R/A173V/ Y189L/I219V/A263G/Q283H/L288S/ N290Q/Q304R/A344T/H366E/G368D | ++ | +++ | |
| 1039/1040 | A396R | S11M/G55K/L69I/Q165R/A173V/ Y189L/I219V/A263G/Q283H/N290Q/ Q304R/A344T/H366E/G368D/A396R | + | + | +++ |
| 1041/1042 | A229H | S11M/G55K/L69I/Q165R/A173V/ Y189L/I219V/A229H/A263G/Q283H/ N290Q/Q304R/A344T/H366E/G368D | ++ | ++ | |
| 1043/1044 | A301D | S11M/G55K/L69I/Q165R/A173V/ Y189L/I219V/A263G/Q283H/N290Q/ A301D/Q304R/A344T/H366E/G368D | ++ | ++ | + |
| 1045/1046 | A301Q | S11M/G55K/L69I/Q165R/A173V/ Y189L/I219V/A263G/Q283H/N290Q/ A301Q/Q304R/A344T/H366E/G368D | + | + | ++ |
| 1047/1048 | L288M | S11M/G55K/L69I/Q165R/A173V/ Y189L/I219V/A263G/Q283H/L288M/ N290Q/Q304R/A344T/H366E/G368D | + | ++ | + |
| 1049/1050 | E127V | S11M/G55K/L69I/E127V/Q165R/ A173V/Y189L/I219V/A263G/Q283H/ N290Q/Q304R/A344T/H366E/G368D | + | ++ | |
| 1051/1052 | A398G | S11M/G55K/L69I/Q165R/A173V/ Y189L/I219V/A263G/Q283H/N290Q/ Q304R/A344T/H366E/G368D/A398G | ++ | + | ++ |
| 1053/1054 | Q141S | S11M/G55K/L69I/Q141S/Q165R/ A173V/Y189L/I219V/A263G/Q283H/ N290Q/Q304R/A344T/H366E/G368D | + | ++ | |
| 1055/1056 | P284A | S11M/G55K/L69I/Q165R/A173V/ Y189L/I219V/A263G/Q283H/P284A/ N290Q/Q304R/A344T/H366E/G368D | + | ++ | |
| 1057/1058 | A398Q | S11M/G55K/L69I/Q165R/A173V/ Y189L/I219V/A263G/Q283H/N290Q/ Q304R/A344T/H366E/G368D/A398Q | ++ | + | + |
| 1059/1060 | L288Q | S11M/G55K/L69I/Q165R/A173V/ Y189L/I219V/A263G/Q283H/L288Q/ N290Q/Q304R/A344T/H366E/G368D | + | ++ | |
| 1061/1062 | Q141R | S11M/G55K/L69I/Q141R/Q165R/ A173V/Y189L/I219V/A263G/Q283H/ N290Q/Q304R/A344T/H366E/G368D | + | ++ | ++ |
| 1063/1064 | P149D/A298P | S11M/G55K/L69I/P149D/Q165R/ A173V/Y189L/I219V/A263G/Q283H/ N290Q/A298P/Q304R/A344T/H366E/ G368D | ++ | ++ | |
| 1065/1066 | H57Y/K240R | S11M/G55K/H57Y/L69I/Q165R/ A173V/Y189L/I219V/K240R/A263G/ Q283H/N290Q/Q304R/A344T/H366E/ G368D | | +++ | ++++ |
| 1067/1068 | H279F/R282A | S11M/G55K/L69I/Q165R/A173V/ Y189L/I219V/A263G/H279F/R282A/ Q283H/N290Q/Q304R/A344T/H366E/ G368D | +++ | ++ | +++ |
| 1069/1070 | N5H/Q141E/ G178A/K240R | N5H/S11M/G55K/L69I/Q141E/ Q165R/A173V/G178A/Y189L/I219V/ K240R/A263G/Q283H/N290Q/Q304R/ A344T/H366E/G368D | | | ++++ |

TABLE 3-7-continued

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FIOP 65° C./ pH 4 | FIOP 65° C./ protease |
|---|---|---|---|---|---|
| 1071/1072 | A298P | S11M/G55K/L69I/Q165R/A173V/ Y189L/I219V/A263G/Q283H/N290Q/ A298P/Q304R/A344T/H366E/G368D | ++ |  | ++ |
| 1073/1074 | H57Y/N272S | S11M/G55K/H57Y/L69I/Q165R/ A173V/Y189L/I219V/A263G/N272S/ Q283H/N290Q/Q304R/A344T/H366E/ G368D |  |  | +++ |
| 1075/1076 | E127K/T344A | S11M/G55K/L69I/E127K/Q165R/ A173V/Y189L/I219V/A263G/Q283H/ N290Q/Q304R/H366E/G368D | ++ | +++ |  |
| 1077/1078 | N7E/H57Y/ Q141E/H279F/ A298P/K395D | N7E/S11M/G55K/H57Y/L69I/Q141E/ Q165R/A173V/Y189L/I219V/A263G/ H279F/Q283H/N290Q/A298P/Q304R/ A344T/H366E/G368D/K395D | ++ | ++ | +++ |
| 1079/1080 | G263A | S11M/G55K/L69I/Q165R/A173V/ Y189L/I219V/Q283H/N290Q/Q304R/ A344T/H366E/G368D | ++ | + | +++ |
| 1081/1082 | N5H | N5H/S11M/G55K/L69I/Q165R/ A173V/Y189L/I219V/A263G/Q283H/ N290Q/Q304R/A344T/H366E/G368D | ++ | ++ | + |
| 1083/1084 | N7E/K240R | N7E/S11M/G55K/L69I/Q165R/A173V/ Y189L/I219V/K240R/A263G/Q283H/ N290Q/Q304R/A344T/H366E/G368D | + | +++ | ++++ |
| 1085/1086 | P149D | S11M/G55K/L69I/P149D/Q165R/ A173V/Y189L/I219V/A263G/Q283H/ N290Q/Q304R/A344T/H366E/G368D | + | +++ | ++ |
| 1087/1088 | R233Q/K240R/ G263A/N272S/ K395D | S11M/G55K/L69I/Q165R/A173V/ Y189L/I219V/R233Q/K240R/N272S/ Q283H/N290Q/Q304R/A344T/H366E/ G368D/K395D |  |  | +++ |
| 1089/1090 | E54R/N272S | S11M/E54R/G55K/L69I/Q165R/ A173V/Y189L/I219V/A263G/N272S/ Q283H/N290Q/Q304R/A344T/H366E/ G368D |  | +++ |  |
| 1091/1092 | Q141E | S11M/G55K/L69I/Q141E/Q165R/ A173V/Y189L/I219V/A263G/Q283H/ N290Q/Q304R/A344T/H366E/G368D | +++ | ++ | +++ |
| 1093/1094 | H57Y | S11M/G55K/H57Y/L69I/Q165R/ A173V/Y189L/I219V/A263G/Q283H/ N290Q/Q304R/A344T/H366E/G368D | + | +++ | ++++ |
| 1095/1096 | K240R/T344A | S11M/G55K/L69I/Q165R/A173V/ Y189L/I219V/K240R/A263G/Q283H/ N290Q/Q304R/H366E/G368D | ++ | +++ | ++++ |
| 1097/1098 | E127K/P149D/ K240R/A298P | S11M/G55K/L69I/E127K/P149D/ Q165R/A173V/Y189L/I219V/K240R/ A263G/Q283H/N290Q/A298P/Q304R/ A344T/H366E/G368D | ++ | ++ | ++++ |
| 1099/1100 | N5H/E127K/ P149D/K240R/ T344A/K395D | N5H/S11M/G55K/L69I/E127K/P149D/ Q165R/A173V/Y189L/I219V/K240R/ A263G/Q283H/N290Q/Q304R/H366E/ G368D/K395D | ++ | +++ | ++++ |
| 1101/1102 | T344A | S11M/G55K/L69I/Q165R/A173V/ Y189L/I219V/A263G/Q283H/N290Q/ Q304R/H366E/G368D | ++ | +++ |  |
| 1103/1104 | N5H/N7E/P149D | N5H/N7E/S11M/G55K/L69I/P149D/ Q165R/A173V/Y189L/I219V/A263G/ Q283H/N290Q/Q304R/A344T/H366E/ G368D | ++ | +++ | + |
| 1105/1106 | N7E/N272S | N7E/S11M/G55K/L69I/Q165R/A173V/ Y189L/I219V/A263G/N272S/Q283H/ N290Q/Q304R/A344T/H366E/G368D | + | +++ |  |
| 1107/1108 | N7E/G178A/ K240R | N7E/S11M/G55K/L69I/Q165R/A173V/ G178A/Y189L/I219V/K240R/A263G/ Q283H/N290Q/Q304R/A344T/H366E/ G368D |  |  | +++ |
| 1109/1110 | N5H/K240R | N5H/S11M/G55K/L69I/Q165R/ A173V/Y189L/I219V/K240R/A263G/ Q283H/N290Q/Q304R/A344T/H366E/ G368D |  | +++ | ++++ |

TABLE 3-7-continued

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FiOP 65° C./ pH 4 | FIOP 65° C./ protease |
|---|---|---|---|---|---|
| 1111/1112 | K395D | S11M/G55K/L69I/Q165R/A173V/ Y189L/I219V/A263G/Q283H/N290Q/ Q304R/A344T/H366E/G368D/K395D | ++ | | |
| 1113/1114 | R282A | S11M/G55K/L69I/Q165R/A173V/ Y189L/I219V/A263G/R282A/Q283H/ N290Q/Q304R/A34D4T/H366E/G368 | ++ | + | +++ |
| 1115/1116 | D3P/Q141E/ K395D | D3P/S11M/G55K/L69I/Q141E/Q165R/ A173V/Y189L/I219V/A263G/Q283H/ N290Q/Q304R/A344T/H366E/G368D/ K395D | ++ | ++ | |
| 1117/1118 | E127K/H279F/ R282A/T344A | S11M/G55K/L69I/E127K/Q165R/ A173V/Y189L/I219V/A263G/H279F/ R282A/Q283H/N290Q/Q304R/H366E/ G368D | ++ | +++ | + |
| 1119/1120 | N7E/E127K/ K240R | N7E/S11M/G55K/L69I/E127K/Q165R/ A173V/Y189L/I219V/K240R/A263G/ Q283H/N290Q/Q304R/A344T/H366E/ G368D | + | | ++++ |
| 1121/1122 | N5H/N7E | N5H/N7E/S11M/G55K/L69I/Q165R/ A173V/Y189L/I219V/A263G/Q283H/ N290Q/Q304R/A344T/H366E/G368D | | +++ | |
| 1123/1124 | P149D/R282A | S11M/G55K/L69I/P149D/Q165R/ A173V/Y189L/I219V/A263G/R282A/ Q283H/N290Q/Q304R/A344T/H366E/ G368D | +++ | ++ | +++ |
| 1125/1126 | P149D/K240R/ N272S | S11M/G55K/L69I/P149D/Q165R/ A173V/Y189L/I219V/K240R/A263G/ N272S/Q283H/N290Q/Q304R/A344T/ H366E/G368D | + | +++ | ++++ |
| 1127/1128 | T344A/K395D | S11M/G55K/L69I/Q165R/A173V/ Y189L/I219V/A263G/Q283H/N290Q/ Q304R/H366E/G368D/K395D | ++ | ++++ | |
| 1129/1130 | E127K/K240R | S11M/G55K/L69I/E127K/Q165R/ A173V/Y189L/I219V/K240R/A263G/ Q283H/N290Q/Q304R/A344T/H366E/ G368D | | | ++++ |
| 1131/1132 | E127K | S11M/G55K/L69I/E127K/Q165R/ A173V/Y189L/I219V/A263G/Q283H/ N290Q/Q304R/A344T/H366E/G368D | + | | ++ |
| 1133/1134 | P149D/N272S/ R282A/A298P/ T344A | S11M/G55K/L69I/P149D/Q165R/ A173V/Y189L/I219V/A263G/N272S/ R282A/Q283H/N290Q/A298P/Q304R/ H366E/G368D | ++ | ++++ | |
| 1135/1136 | P149D/N272S/ T344A/K395D | S11M/G55K/L69I/P149D/Q165R/ A173V/Y189L/I219V/A263G/N272S/ Q283H/N290Q/Q304R/H366E/G368D/ K395D | + | ++++ | |
| 1137/1138 | K240R | S11M/G55K/L69I/Q165R/A173V/ Y189L/I219V/K240R/A263G/Q283H/ N290Q/Q304R/A344T/H366E/G368D | | + | ++++ |
| 1139/1140 | Q141E/H279F | S11M/G55K/L69I/Q141E/Q165R/ A173V/Y189L/I219V/A263G/H279F/ Q283H/N290Q/Q304R/A344T/H366E/ G368D/ | ++ | ++ | +++ |
| 1141/1142 | E54R/H57Y/ T344A | S11M/E54R/G55K/H57Y/L69I/Q165R/ A173V/Y189L/I219V/A263G/Q283H/ N290Q/Q304R/H366E/G368D | | ++++ | |
| 1143/1144 | E54R/E127K/ R282A | S11M/E54R/G55K/L69I/E127K/ Q165R/A173V/Y189L/I219V/A263G/ R282A/Q283H/N290Q/Q304R/A344T/ H366E/G368D | ++ | + | |
| 1145/1146 | N7E/P41E/P149D/ T344A | N7E/S11M/P41E/G55K/L69I/P149D/ Q165R/A173V/Y189L/I219V/A263G/ Q283H/N290Q/Q304R/H366E/G368D | | ++++ | |
| 1147/1148 | N7E/K240R/ N272S/K395D | N7E/S11M/G55K/L69I/Q165R/A173V/ Y189L/I219V/K240R/A263G/N272S/ Q283H/N290Q/Q304R/A344T/H366E/ G368D/K395D | | | ++++ |

TABLE 3-7-continued

Methionine Gamma Lyase Activity (Relative to SEQ ID NO: 916)[1]

| SEQ ID NO: (nt/aa) | Amino Acid Differences (Relative to SEQ ID NO: 916) | Amino Acid Differences (Relative to SEQ ID NO: 2) | FIOP 65° C. Low Met | FIOP 65° C./ pH 4 | FIOP 65° C./ protease |
|---|---|---|---|---|---|
| 1149/1150 | K240R/G263A | S11M/G55K/L69I/Q165R/A173V/ Y189L/I219V/K240R/Q283H/N290Q/ Q304R/A344T/H366E/G368D | | | ++++ |
| 1151/1152 | Q141E/P149D/ T344A | S11M/G55K/L69I/Q141E/P149D/ Q165R/A173V/Y189L/I219V/A263G/ Q283H/N290Q/Q304R/H366E/G368D | ++ | ++++ | |
| 1153/1154 | E127K/P149D/ N272S/H279F/ R282A/A298P/ T344A | S11M/G55K/L69I/E127K/P149D/ Q165R/A173V/Y189L/I219V/A263G/ N272S/H279F/R282A/Q283H/N290Q/ A298P/Q304R/H366E/G368D | + | ++++ | |
| 1155/1156 | N5H/N7E/E54R/ H57Y/T344A | N5H/N7E/S11M/E54R/G55K/H57Y/ L69I/Q165R/A173V/Y189L/I219V/ A263G/Q283H/N290Q/Q304R/H366E/ G368D | | ++++ | |
| 1157/1158 | N5H/P41E/N272S/ H279F | N5H/S11M/P41E/G55K/L69I/Q165R/ A173V/Y189L/I219V/A263G/N272S/ H279F/Q283H/N290Q/Q304R/A344T/ H366E/G368D | | ++++ | |
| 1159/1160 | N7E/E54R/ E127K/K228A/ K240R/A298P/ T344A | N7E/S11M/E54R/G55K/L69I/E127K/ Q165R/A173V/Y189L/I219V/K228A/ K240R/A263G/Q283H/N290Q/A298P/ Q304R/H366E/G368D | + | ++++ | |
| 1161/1162 | H57Y/A298P | S11M/G55K/H57Y/L69I/Q165R/ A173V/Y189L/I219V/A263G/Q283H/ N290Q/A298P/Q304R/A344T/H366E/ G368D | ++ | | ++++ |
| 1163/1164 | N5H/K240R/ N272S/A298P/ T344A | N5H/S11M/G55K/L69I/Q165R/ A173V/Y189L/I219V/K240R/A263G/ N272S/Q283H/N290Q/A298P/Q304R/ H366E/G368D | + | ++++ | ++++ |
| 1165/1166 | P149D/T344A | S11M/G55K/L69I/P149D/Q165R/ A173V/Y189L/I219V/A263G/Q283H/ N290Q/Q304R/H366E/G368D | + | ++++ | |
| 1167/1168 | D3P/H57Y/V173A | D3P/S11M/G55K/H57Y/L69I/Q165R/ Y189L/I219V/A263G/Q283H/N290Q/ Q304R/A344T/H366E/G368D | + | +++ | +++ |
| 1169/1170 | Q141E/G263A/ N272S/T344A | S11M/G55K/L69I/Q141E/Q165R/ A173V/Y189L/I219V/N272S/Q283H/ N290Q/Q304R/H366E/G368D | ++ | ++++ | |
| 1171/1172 | H57Y/Q141E/ T344A | S11M/G55K/H57Y/L69I/Q141E/Q165R/ A173V/Y189L/I219V/A263G/ Q283H/N290Q/Q304R/H366E/G368D | ++ | ++++ | +++ |
| 1173/1174 | H57Y/E127K/ T344A | S11M/G55K/H57Y/L69I/E127K/ Q165R/A173V/Y189L/I219V/A263G/ Q283H/N290Q/Q304R/H366E/G368D | + | ++++ | +++ |

Levels of increased activity were determined relative to the reference polypeptide of SEQ ID NO: 916, and defined as follows:
"+" > 0.9;
"++" > 1.1;
"+++" > 1.5; and
"++++" > 3.

Based on the results shown in Table 3-7, SEQ ID NO: 1172 was chosen as the next backbone for evolution. Beneficial mutations identified based on the results shown in Table 3-7 were recombined into the backbone. The variants were assayed as described in Example 2. The only difference was that the low pH challenge was performed at pH 4.5, instead of pH 5.2. The results are provided in Table 3-8. In this Table, the amino acid differences are indicated relative to SEQ ID NO: 1172.

TABLE 3-8

Methionine Gamma Lyase Activity (Relative to SEQ ID NO: 1172)[1]

| SEQ ID NO: (nt/aa) | Amino Acid Differences (Relative to SEQ ID NO: 1172) | Amino Acid Differences (Relative to SEQ ID NO: 2) | FIOP 65° C./ protease | FIOP 65° C./ pH 4 | FIOP 65° C./ Low Met |
|---|---|---|---|---|---|
| 1175/1176 | V276I/L341F/ | S11M/G55K/H57Y/L69I/Q141E/ Q165R/A173V/Y189L/I219V/A263G/ V276I/Q283H/N290Q/Q304R/ L341F/H366E/G368D | ++++ | +++ | ++++ |

TABLE 3-8-continued

Methionine Gamma Lyase Activity (Relative to SEQ ID NO: 1172)[1]

| SEQ ID NO: (nt/aa) | Amino Acid Differences (Relative to SEQ ID NO: 1172) | Amino Acid Differences (Relative to SEQ ID NO: 2) | FIOP 65° C./ protease | FIOP 65° C./ pH 4 | FIOP 65° C./ Low Met |
|---|---|---|---|---|---|
| 1177/1178 | K240R/A298K | S11M/G55K/H57Y/L69I/Q141E/ Q165R/A173V/Y189L/I219V/K240R/ A263G/Q283H/N290Q/A298K/ Q304R/H366E/G368D | ++++ | ++ | +++ |
| 1179/1180 | L239K/K240R/ V276I/L341F | S11M/G55K/H57Y/L69I/Q141E/ Q165R/A173V/Y189L/I219V/L239K/ K240R/A263G/V276I/Q283H/N290Q/ Q304R/L341F/H366E/G368D | ++++ | ++ | +++ |
| 1181/1182 | V219L/V276I/ F335I | S11M/G55K/H57Y/L69I/Q141E/ Q165R/A173V/Y189L/I219L/A263G/ V276I/Q283H/N290Q/Q304R/F335I/ H366E/G368D | ++++ | +++ | ++++ |
| 1183/1184 | S23K/K240R/ L255V/H279F | S11M/S23K/G55K/H57Y/L69I/ Q141E/Q165R/A173V/Y189L/I219V/ K240R/L255V/A263G/H279F/Q283H/ N290Q/Q304R/H366E/G368D | ++++ | +++ | +++ |
| 1185/1186 | V276I/F335I/ L341F | S11M/G55K/H57Y/L69I/Q141E/ Q165R/A173V/Y189L/I219V/A263G/ V276I/Q283H/N290Q/Q304R/F335I/ L341F/H366E/G368D | ++++ | +++ | ++++ |
| 1187/1188 | V219L/K240R | S11M/G55K/H57Y/L69I/Q141E/ Q165R/A173V/Y189L/I219L/K240R/ A263G/Q283H/N290Q/Q304R/ H366E/G368D | ++++ |  | + |
| 1189/1190 | H279F/L341F | S11M/G55K/H57Y/L69I/Q141E/ Q165R/A173V/Y189L/I219V/A263G/ H279F/Q283H/N290Q/Q304R/L341F/ H366E/G368D | ++++ | +++ | ++++ |
| 1191/1192 | S23K/V219L/ V276I/A298K | S11M/S23K/G55K/H57Y/L69I/ Q141E/Q165R/A173V/Y189L/I219L/ A263G/V276I/Q283H/N290Q/ A298K/Q304R/H366E/G368D | ++++ | +++ | +++ |
| 1193/1194 | L341F | S11M/G55K/H57Y/L69I/Q141E/ Q165R/A173V/Y189L/I219V/A263G/ Q283H/N290Q/Q304R/L341F/H366E/ G368D | ++++ | +++ | ++++ |
| 1195/1196 | S23K/V219L/ A298K/L341F | S11M/S23K/G55K/H57Y/L69I/ Q141E/Q165R/A173V/Y189L/I219L/ A263G/Q283H/N290Q/A298K/ Q304R/L341F/H366E/G368D | ++++ | +++ | +++ |
| 1197/1198 | S23K/K240R/ L255V/V276I/ A324S/F335I | S11M/S23K/G55K/H57Y/L69I/ Q141E/Q165R/A173V/Y189L/I219V/ K240R/L255V/A263G/V276I/Q283H/ N290Q/Q304R/A324S/F335I/ H366E/G368D | ++++ | +++ | +++ |
| 1199/1200 | A298P/L341F | S11M/G55K/H57Y/L69I/Q141E/ Q165R/A173V/Y189L/I219V/A263G/ Q283H/N290Q/A298P/Q304R/L341F/ H366E/G368D | ++++ | +++ | ++++ |
| 1201/1202 | V276I/H279F/ A324S/F335I/ L341F | S11M/G55K/H57Y/L69I/Q141E/ Q165R/A173V/Y189L/I219V/A263G/ V276I/H279F/Q283H/N290Q/Q304R/ A324S/F335I/L341F/H366E/G368D | ++++ | + | ++++ |
| 1203/1204 | F335I | S11M/G55K/H57Y/L69I/Q141E/ Q165R/A173V/Y189L/I219V/A263G/ Q283H/N290Q/Q304R/F335I/H366E/ G368D | ++++ | ++ | ++++ |
| 1205/1206 | V219L/K240R/ V276I/F335I | S11M/G55K/H57Y/L69I/Q141E/ Q165R/A173V/Y189L/I219L/K240R/ A263G/V276I/Q283H/N290Q/Q304R/ F335I/H366E/G368D | ++++ | ++ | ++++ |
| 1207/1208 | L255V/A298K/ L341F | S11M/G55K/H57Y/L69I/Q141E/ Q165R/A173V/Y189L/I219V/L255V/ A263G/Q283H/N290Q/A298K/ Q304R/L341F/H366E/G368D | ++++ | +++ | ++++ |
| 1209/1210 | V219L/H279F/ L341F | S11M/G55K/H57Y/L69I/Q141E/ Q165R/A173V/Y189L/I219L/A263G/ H279F/Q283H/N290Q/Q304R/L341F/ H366E/G368D | ++++ | +++ | +++ |
| 1211/1212 | L239K/H279F/ L341F | S11M/G55K/H57Y/L69I/Q141E/ Q165R/A173V/Y189L/I219V/L239K/ A263G/H279F/Q283H/N290Q/ Q304R/L341F/H366E/G368D | ++++ | +++ | +++ |

TABLE 3-8-continued

Methionine Gamma Lyase Activity (Relative to SEQ ID NO: 1172)[1]

| SEQ ID NO: (nt/aa) | Amino Acid Differences (Relative to SEQ ID NO: 1172) | Amino Acid Differences (Relative to SEQ ID NO: 2) | FIOP 65° C./ protease | FIOP 65° C./ pH 4 | FIOP 65° C./ Low Met |
|---|---|---|---|---|---|
| 1213/1214 | S23K/V276I/ A298K/A324S | S11M/S23K/G55K/H57Y/L69I/ Q141E/Q165R/A173V/Y189L/I219V/ A263G/V276I/Q283H/N290Q/ A298K/Q304R/A324S/H366E/G368D | ++++ | +++ | +++ |
| 1215/1216 | S23K/L239K/ L255V/V276I/ H279F/F335I/ L341F | S11M/S23K/G55K/H57Y/L69I/ Q141E/Q165R/A173V/Y189L/I219V/ L239K/L255V/A263G/V276I/H279F/ Q283H/N290Q/Q304R/F335I/L341F/ H366E/G368D | ++++ | +++ | +++ |
| 1217/1218 | V219L/V276I/ A298K/A324S/ F335I | S11M/G55K/H57Y/L69I/Q141E/ Q165R/A173V/Y189L/I219L/A263G/ V276I/Q283H/N290Q/A298K/ Q304R/A324S/F335I/H366E/G368D | ++++ | +++ | +++ |
| 1219/1220 | L239K/K240R/ V276I/F316L | S11M/G55K/H57Y/L69I/Q141E/ Q165R/A173V/Y189L/I219V/L239K/ K240R/A263G/V276I/Q283H/N290Q/ Q304R/F316L/H366E/G368D | ++++ | | ++ |
| 1221/1222 | K240R | S11M/G55K/H57Y/L69I/Q141E/ Q165R/A173V/Y189L/I219V/K240R/ A263G/Q283H/N290Q/Q304R/ H366E/G368D | ++++ | ++ | +++ |
| 1223/1224 | V276I/A298K/ A324S/F335I | S11M/G55K/H57Y/L69I/Q141E/ Q165R/A173V/Y189L/I219V/A263G/ V276I/Q283H/N290Q/A298K/ Q304R/A324S/F335I/H366E/G368D | ++++ | +++ | +++ |
| 1225/1226 | S23K/V219L/ L239K/L341F | S11M/S23K/G55K/H57Y/L69I/ Q141E/Q165R/A173V/Y189L/I219L/ L239K/A263G/Q283H/N290Q/ Q304R/L341F/H366E/G368D | ++++ | +++ | +++ |
| 1227/1228 | S23K/L341F | S11M/S23K/G55K/H57Y/L69I/ Q141E/Q165R/A173V/Y189L/I219V/ A263G/Q283H/N290Q/Q304R/ L341F/H366E/G368D | ++++ | +++ | +++ |
| 1229/1230 | S23K/L255V/ V276I/A298K | S11M/S23K/G55K/H57Y/L69I/ Q141E/Q165R/A173V/Y189L/I219V/ L255V/A263G/V276I/Q283H/N290Q/ A298K/Q304R/H366E/G368D | ++++ | +++ | +++ |
| 1231/1232 | S23K/V219L/ V276I/L341F | S11M/S23K/G55K/H57Y/L69I/ 4Q11E/Q165R/A173V/Y189L/I219L/ A263G/V276I/Q283H/N290Q/Q304R/ L341F/H366E/G368D | ++++ | +++ | +++ |
| 1233/1234 | S23K/V276I/ A298K/A324S/ F335I | S11M/S23K/G55K/H57Y/L69I/ Q141E/Q165R/A173V/Y189L/I219V/ A263G/V276I/Q283H/N290Q/ A298K/Q304R/A324S/F335I/H366E/ G368D | ++++ | +++ | ++++ |
| 1235/1236 | L239K/K240R/ L255V/V276I/ A298P/F316L/ F335I | S11M/G55K/H57Y/L69I/Q141E/ Q165R/A173V/Y189L/I219V/L239K/ K240R/L255V/A263G/V276I/ Q283H/N290Q/A298P/Q304R/F316L/ F335I/H366E/G368D | ++++ | + | +++ |
| 1237/1238 | S23K/K240R/ V276I/A298K | S11M/S23K/G55K/H57Y/L69I/ Q141E/Q165R/A173V/Y189L/I219V/ K240R/A263G/V276I/Q283H/N290Q/ A298K/Q304R/H366E/G368D | ++++ | +++ | +++ |
| 1239/1240 | K240R/H279F | S11M/G55K/H57Y/L69I/Q141E/ Q165R/A173V/Y189L/I219V/K240R/ A263G/H279F/Q283H/N290Q/ Q304R/H366E/G368D | ++++ | + | +++ |
| 1241/1242 | S23K/H279F/ F335I | S11M/S23K/G55K/H57Y/L69I/ Q141E/Q165R/A173V/Y189L/I219V/ A263G/H279F/Q283H/N290Q/ Q304R/F335I/H366E/G368D | ++++ | +++ | +++ |
| 1243/1244 | S23K/V219L/ K240R/V276I/ A298K/A324S | S11M/S23K/G55K/H57Y/L69I/ Q141E/Q165R/A173V/Y189L/I219L/ K240R/A263G/V276I/Q283H/N290Q/ A298K/Q304R/A324S/H366E/G368D | ++++ | +++ | |

TABLE 3-8-continued

Methionine Gamma Lyase Activity (Relative to SEQ ID NO: 1172)[1]

| SEQ ID NO: (nt/aa) | Amino Acid Differences (Relative to SEQ ID NO: 1172) | Amino Acid Differences (Relative to SEQ ID NO: 2) | FIOP 65° C./ protease | FIOP 65° C./ pH 4 | FIOP 65° C./ Low Met |
|---|---|---|---|---|---|
| 1245/1246 | S23K/V219L/ K240R/V276I/ H279F/A298K | S11M/S23K/G55K/H57Y/L69I/ Q141E/Q165R/A173V/Y189L/I219L/ K240R/A263G/V276I/H279F/Q283H/ N290Q/A298K/Q304R/H366E/ G368D | ++++ | | +++ |
| 1247/1248 | V276I/H279F/ A298P/F316L | S11M/G55K/H57Y/L69I/Q141E/ Q165R/A173V/Y189L/I219V/A263G/ V276I/H279F/Q283H/N290Q/A298P/ Q304R/F316L/H366E/G368D | ++++ | | +++ |
| 1249/1250 | L239K/H279F/ A298K/F335I/ L341F | S11M/G55K/H57Y/L69I/Q141E/ Q165R/A173V/Y189L/I219V/L239K/ A263G/H279F/Q283H/N290Q/ A298K/Q304R/F335I/L341F/H366E/ G368D | ++++ | +++ | +++ |
| 1251/1252 | S23K/L239K/ K240R/L255V/ V276I/H279F/ A298P/A324S | S11M/S23K/G55K/H57Y/L69I/ Q141E/Q165R/A173V/Y189L/I219V/ L239K/K240R/L255V/A263G/V276I/ H279F/Q283H/N290Q/A298P/ Q304R/A324S/H366E/G368D | ++++ | | ++ |
| 1253/1254 | K240R/V276I/ H279F | S11M/G55K/H57Y/L69I/Q141E/ Q165R/A173V/Y189L/I219V/K240R/ A263G/V276I/H279F/Q283H/ N290Q/Q304R/H366E/G368D | ++++ | | ++ |
| 1255/1256 | S23K/H279F/ R282A/F335I/ A396V | S11M/S23K/G55K/H57Y/L69I/ Q141E/Q165R/A173V/Y189L/I219V/ A263G/H279F/R282A/Q283H/ N290Q/Q304R/F335I/H366E/G368D/ A396V | ++++ | ++ | ++++ |
| 1257/1258 | A298P/A301Q | S11M/G55K/H57Y/L69I/Q141E/ Q165R/A173V/Y189L/I219V/A263G/ Q283H/N290Q/A298P/A301Q/ Q304R/H366E/G368D | +++ | + | +++ |
| 1259/1260 | V219L/L223I/ V276I/F335I | S11M/G55K/H57Y/L69I/Q141E/ Q165R/A173V/Y189L/I219L/L223I/ A263G/V276I/Q283H/N290Q/ Q304R/F335I/H366E/G368D | ++++ | +++ | ++++ |
| 1261/1262 | V219L/V276I/ H279F/A298K/ A301Q | S11M/G55K/H57Y/L69I/Q141E/ Q165R/A173V/Y189L/I219L/A263G/ V276I/H279F/Q283H/N290Q/A298K/ A301Q/Q304R/H366E/G368D | ++++ | +++ | ++++ |
| 1263/1264 | L223I/A229S/ H279F/F335I | S11M/G55K/H57Y/L69I/Q141E/ Q165R/A173V/Y189L/I219V/L223I/ A229S/A263G/H279F/Q283H/N290Q/ Q304R/F335I/H366E/G368D | ++++ | + | ++++ |
| 1265/1266 | L223I/L255V | S11M/G55K/H57Y/L69I/Q141E/ Q165R/A173V/Y189L/I219V/L223I/ L255V/A263G/Q283H/N290Q/ Q304R/H366E/G368D | ++++ | +++ | ++++ |
| 1267/1268 | V219L/V276I/ H279F/R282A | S11M/G55K/H57Y/L69I/Q141E/ Q165R/A173V/Y1G/89L/I219L/A263 V276I/H279F/R282A/Q283H/N290Q/ Q304R/H366E/G368D | ++++ | ++ | ++++ |
| 1269/1270 | A229S/L255V/ V276I/R282A/ L341F | S11M/G55K/H57Y/L69I/Q141E/ Q165R/A173V/Y189L/I219V/A229S/ L255V/A263G/V276I/R282A/Q283H/ N290Q/Q304R/L341F/H366E/ G368D | ++++ | | ++++ |
| 1271/1272 | L223I/F335I/ A365K | S11M/G55K/H57Y/L69I/Q141E/ Q165R/A173V/Y189L/I219V/L223I/ A263G/Q283H/N290Q/Q304R/ F335I/A365K/H366E/G368D | ++++ | +++ | ++++ |
| 1273/1274 | V219L/L223I/ V276I/A298P/ L341F/A396V | S11M/G55K/H57Y/L69I/Q141E/ Q165R/A173V/Y189L/I219L/L223I/ A263G/V276I/Q283H/N290Q/ A298P/Q304R/L341F/H366E/G368D/ A396V | ++++ | +++ | ++++ |
| 1275/1276 | G263A/C270S/ V276I | S11M/G55K/H57Y/L69I/Q141E/ Q165R/A173V/Y189L/I219V/C270S/ V276I/Q283H/N290Q/Q304R/H366E/ G368D | +++ | +++ | ++++ |

TABLE 3-8-continued

Methionine Gamma Lyase Activity (Relative to SEQ ID NO: 1172)[1]

| SEQ ID NO: (nt/aa) | Amino Acid Differences (Relative to SEQ ID NO: 1172) | Amino Acid Differences (Relative to SEQ ID NO: 2) | FIOP 65° C./ protease | FIOP 65° C./ pH 4 | FIOP 65° C./ Low Met |
|---|---|---|---|---|---|
| 1277/1278 | S23K/V276I/ R282A/F335I | S11M/S23K/G55K/H57Y/L69I/ Q141E/Q165R/A173V/Y189L/I219V/ A263G/V276I/R282A/Q283H/N290Q/ Q304R/F335I/H366E/G368D | ++++ | +++ | +++ |
| 1279/1280 | S23K/G263A/ V276I/H279F/ R282A/A298K/ L341F | S11M/S23K/G55K/H57Y/L69I/ Q141E/Q165R/A173V/Y189L/I219V/ V276I/H279F/R282A/Q283H/N290Q/ A298K/Q304R/L341F/H366E/ G368D | ++++ | +++ | +++ |
| 1281/1282 | S23K/V219L/ L223I/V276I/ L288I/A298K/ A301Q/A365K | S11M/S23K/G55K/H57Y/L69I/ Q141E/Q165R/A173V/Y189L/I219L/ L223I/A263G/V276I/Q283H/L288I/ N290Q/A298K/A301Q/Q304R/ A365K/H366E/G368D | ++++ | +++ | ++ |
| 1283/1284 | S23K/V219L/ K240R/V276I/ H279F | S11M/S23K/G55K/H57Y/L69I/ Q141E/Q165R/A173V/Y189L/I219L/ K240R/A263G/V276I/H279F/ Q283H/N290Q/Q304R/H366E/G368D | ++++ | | ++ |
| 1285/1286 | V219L/L223I/ K240R/H279F | S11M/G55K/H57Y/L69I/Q141E/ Q165R/A173V/Y189L/I219L/L223I/ K240R/A263G/H279F/Q283H/ N290Q/Q304R/H366E/G368D | ++++ | ++ | +++ |

Levels of increased activity were determined relative to the reference polypeptide of SEQ ID NO: 1172, and defined as follows:
"+" > 0.9;
"++" > 1.1;
"+++" > 1.5; and
"++++" > 3.

Based on the results shown in Table 3-8, SEQ ID NO: 1232 was chosen as the next backbone for evolution. Beneficial mutations identified based on the results shown in Table 3-8 were recombined into the backbone. Additionally, variants were also constructed on SEQ ID NO: 1232, through saturation mutagenesis at different positions. The variants were assayed as described in Example 2. The only difference was that the low pH preincubation was performed at pH 4.0 instead of pH 5.2. The results are provided in Table 3-9. In this Table, the amino acid differences are indicated relative to SEQ ID NO: 1232.

TABLE 3-9

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1287/1288 | L255V | S11M/S23K/G55K/H57Y/L69I/ Q141E/Q165R/A173V/Y189L/ I219L/L255V/A263G/V276I/ Q283H/N290Q/Q304R/L341F/ H366E/G368D | ++ | ++ | ++ | +++ |
| 1289/1290 | L223I/L239K/ K240R/H279F/ F335I | S11M/S23K/G55K/H57Y/L69I/ Q141E/Q165R/A173V/Y189L/ I219L/L223I/L239K/K240R/ A263G/V276I/H279F/Q283H/ N290Q/Q304R/F335I/L341F/ H366E/G368D | + | ++ | +++ | |
| 1291/1292 | K240R/H279F | S11M/S23K/G55K/H57Y/L69I/ Q141E/Q165R/A173V/Y189L/ I219L/K240R/A263G/V276I/ H279F/Q283H/N290Q/Q304R/ L341F/H366E/G368D | | ++ | +++ | ++ |
| 1293/1294 | A298K/F335I | S11M/S23K/G55K/H57Y/L69I/ Q141E/Q165R/A173V/Y189L/ I219L/A263G/V276I/Q283H/ N290Q/A298K/Q304R/F335I/ L341F/H366E/G368D | + | ++ | +++ | ++ |
| 1295/1296 | L223I/H279F/ A298S/F335I | S11M/S23K/G55K/H57Y/L69I/ Q141E/Q165R/A173V/Y189L/ I219L/L223I/A263G/V276I/ | ++ | ++ | +++ | ++ |

TABLE 3-9-continued

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| | | H279F/Q283H/N290Q/A298S/ Q304R/F335I/L341F/H366E/ G368D | | | | |
| 1297/1298 | L223I/L255V/ A298K/F316L | S11M/S23K/G55K/H57Y/L69I/ Q141E/Q165R/A173V/Y189L/ I219L/L223I/L255V/A263G/ V276I/Q283H/N290Q/A298K/ Q304R/F316L/L341F/H366E/ G368D | | | ++ | +++ |
| 1299/1300 | L223I | S11M/S23K/G55K/H57Y/L69I/ Q141E/Q165R/A173V/Y189L/ I219L/L223I/A263G/V276I/ Q283H/N290Q/Q304R/L341F/ H366E/G368D | +++ | ++ | +++ | +++ |
| 1301/1302 | L223I/L239K/ K240R | S11M/S23K/G55K/H57Y/L69I/ Q141E/Q165R/A173V/Y189L/ I219L/L223I/L239K/K240R/ A263G/V276I/Q283H/N290Q/ Q304R/L341F/H366E/G368D | + | ++ | +++ | |
| 1303/1304 | L223I/L288I | S11M/S23K/G55K/H57Y/L69I/ Q141E/Q165R/A173V/Y189L/ I219L/L223I/A263G/V276I/ Q283H/L288I/N290Q/Q304R/ L341F/H366E/G368D | +++ | ++ | +++ | +++ |
| 1305/1306 | L223I/L239K | S11M/S23K/G55K/H57Y/L69I/ Q141E/Q165R/A173V/Y189L/ I219L/L223I/L239K/A263G/ V276I/Q283H/N290Q/Q304R/ L341F/H366E/G368D | ++ | ++ | ++++ | + |
| 1307/1308 | L288I | S11M/S23K/G55K/H57Y/L69I/ Q141E/Q165R/A173V/Y189L/ I219L/A263G/V276I/Q283H/ L288I/N290Q/Q304R/L341F/ H366E/G368D | +++ | ++ | +++ | +++ |
| 1309/1310 | L223I/L255V | S11M/S23K/G55K/H57Y/L69I/ Q141E/Q165R/A173V/Y189L/ I219L/L223I/L255V/A263G/ V276I/Q283H/N290Q/Q304R/ L341F/H366E/G368D | +++ | ++ | +++ | +++ |
| 1311/1312 | L223I/K240R/ A298S | S11M/S23K/G55K/H57Y/L69I/ Q141E/Q165R/A173V/Y189L/ I219L/L223I/K240R/A263G/ V276I/Q283H/N290Q/A298S /Q304R/L341F/H366E/G368D | | ++ | +++ | + |
| 1313/1314 | H279F/A298K/ F335I | S11M/S23K/G55K/H57Y/L69I/ Q141E/Q165R/A173V/Y189L/ I219L/A263G/V276I/H279F/ Q283H/N290Q/A298K/Q304R/ F335I/L341F/H366E/G368D | | + | +++ | +++ |
| 1315/1316 | L223I/L288I/ A298K | S11M/S23K/G55K/H57Y/L69I/ Q141E/Q165R/A173V/Y189L/ I219L/L223I/A263G/V276I/ Q283H/L288I/N290Q/A298K/ Q304R/L341F/H366E/G368D | +++ | ++ | ++++ | +++ |
| 1317/1318 | L255V/F335I | S11M/S23K/G55K/H57Y/L69I/ Q141E/Q165R/A173V/Y189L/ I219L/L255V/A263G/V276I/ Q283H/N290Q/Q304R/F335I/ L341F/H366E/G368D | + | + | +++ | +++ |
| 1319/1320 | L239K/L288I | S11M/S23K/G55K/H57Y/L69I/ Q141E/Q165R/A173V/Y189L/ I219L/L239K/A263G/V276I/ Q283H/L288I/N290Q/Q304R/ L341F/H366E/G368D | ++ | ++ | +++ | +++ |
| 1321/1322 | L223I/L255V/ A298K | S11M/S23K/G55K/H57Y/L69I/ Q141E/Q165R/A173V/Y189L/ I219L/L223I/L255V/A263G/ V276I/Q283H/N290Q/A298K/ Q304R/L341F/H366E/G368D | ++ | ++ | +++ | ++++ |
| 1323/1324 | H279F | S11M/S23K/G55K/H57Y/L69I/ Q141E/Q165R/A173V/Y189L/ I219L/A263G/V276I/H279F/ | +++ | ++ | +++ | +++ |

TABLE 3-9-continued

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1325/1326 | A298K | S11M/S23K/G55K/H57Y/L69I/ Q141E/Q165R/A173V/Y189L/ I219L/A263G/V276I/Q283H/ N290Q/A298K/Q304R/L341F/ H366E/G368D | +++ | ++ | +++ | +++ |
| 1327/1328 | L255V/H279F | S11M/S23K/G55K/H57Y/L69I/ Q141E/Q165R/A173V/Y189L/ I219L/L255V/A263G/V276I/ H279F/Q283H/N290Q/Q304R/ L341F/H366E/G368D | ++ | | +++ | +++ |
| 1329/1330 | L223I/H279F/ F335I | S11M/S23K/G55K/H57Y/L69I/ Q141E/Q165R/A173V/Y189L/ I219L/L223I/A263G/V276I/ H279F/Q283H/N290Q/Q304R/ F335I/L341F/H366E/G368D | +++ | + | +++ | ++ |
| 1331/1332 | L223I/L255V/ F335I | S11M/S23K/G55K/H57Y/L69I/ Q141E/Q165R/A173V/Y189L/ I219L/L223I/L255V/A263G/ V276I/Q283H/N290Q/Q304R/ F335I/L341F/H366E/G368D | ++ | + | +++ | +++ |
| 1333/1334 | L255V/A298P | S11M/S23K/G55K/H57Y/L69I/ Q141E/Q165R/A173V/Y189L/ I219L/L255V/A263G/V276I/ Q283H/N290Q/A298P/Q304R/ L341F/H366E/G368D | +++ | ++ | +++ | +++ |
| 1335/1336 | L239K/H279F/ A298K/F316L | S11M/S23K/G55K/H57Y/L69I/ Q141E/Q165R/A173V/Y189L/ I219L/L239K/A263G/V276I/ H279F/Q283H/N290Q/A298K/ Q304R/F316L/L341F/H366E/ G368D | | | +++ | +++ |
| 1337/1338 | L223I/L239K/ F316L/F335I | S11M/S23K/G55K/H57Y/L69I/ Q141E/Q165R/A173V/Y189L/ I219L/L223I/L239K/A263G/ V276I/Q283H/N290Q/Q304R/ F316L/F335I/L341F/H366E/ G368D | | + | ++++ | +++ |
| 1339/1340 | K240R/L255V | S11M/S23K/G55K/H57Y/L69I/ Q141E/Q165R/A173V/Y189L/ I219L/K240R/L255V/A263G/ V276I/Q283H/N290Q/Q304R/ L341F/H366E/G368D | | | ++ | +++ |
| 1341/1342 | L223I/A298S | S11M/S23K/G55K/H57Y/L69I/ Q141E/Q165R/A173V/Y189L/ I219L/L223I/A263G/V276I/ Q283H/N290Q/A298S/Q304R/ L341F/H366E/G368D | +++ | ++ | +++ | +++ |
| 1343/1344 | L223I/F335I | S11M/S23K/G55K/H57Y/L69I/ Q141E/Q165R/A173V/Y189L/ I219L/L223I/A263G/V276I/ Q283H/N290Q/Q304R/F335I/ L341F/H366E/G368D | +++ | + | +++ | + |
| 1345/1346 | L223I/H279F/ A298S/*399- | S11M/S23K/G55K/H57Y/L69I/ Q141E/Q165R/A173V/Y189L/ I219L/L223I/A263G/V276I/ H279F/Q283H/N290Q/A298S/ Q304R/L341F/H366E/G368D | +++ | ++ | ++++ | ++++ |
| 1347/1348 | L223I/L239K/ A298K/F316L | S11M/S23K/G55K/H57Y/L69I/ Q141E/Q165R/A173V/Y189L/ I219L/L223I/L239K/A263G/ V276I/Q283H/N290Q/A298K/ Q304R/F316L/L341F/H366E/ G368D | | ++ | +++ | ++++ |
| 1349/1350 | L223I/F316L | S11M/S23K/G55K/H57Y/L69I/ Q141E/Q165R/A173V/Y189L/ I219L/L223I/A263G/V276I/ Q283H/N290Q/Q304R/F316L/ L341F/H366E/G368D | ++ | + | ++ | ++ |
| 1351/1352 | F316L | S11M/S23K/G55K/H57Y/L69I/ Q141E/Q165R/A173V/Y189L/ | | | + | ++ |

TABLE 3-9-continued

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1353/1354 | L223I/L239K/ L255V/F316L | I219L/A263G/V276I/Q283H/ N290Q/Q304R/F316L/L341F/ H366E/G368D S11M/S23K/G55K/H57Y/L69I/ Q141E/Q165R/A173V/Y189L/ I219L/L223I/L239K/L255V/ A263G/V276I/Q283H/N290Q/ Q304R/F316L/L341F/H366E/ G368D | | | +++ | +++ |
| 1355/1356 | K240R/L288I/ F335I | S11M/S23K/G55K/H57Y/L69I/ Q141E/Q165R/A173V/Y189L/ I219L/K240R/A263G/V276I/ Q283H/L288I/N290Q/Q304R/ F335I/L341F/H366E/G368D | | | +++ | |
| 1357/1358 | L239K | S11M/S23K/G55K/H57Y/L69I/ Q141E/Q165R/A173V/Y189L/ I219L/L239K/A263G/V276I/ Q283H/N290Q/Q304R/L341F/ H366E/G368D | ++ | ++ | ++++ | +++ |
| 1359/1360 | N5T | N5T/S11M/S23K/G55K/H57Y/ L69I/Q141E/Q165R/A173V/ Y189L/I219L/A263G/V276I/ Q283H/N290Q/Q304R/L341F/ H366E/G368D | + | ++ | ++ | +++ |
| 1361/1362 | H17C | S11M/H17C/S23K/G55K/H57Y/ L69I/Q141E/Q165R/A173V/ Y189L/I219L/A263G/V276I/ Q283H/N290Q/Q304R/L341F/ H366E/G368D | + | ++ | ++ | +++ |
| 1363/1364 | H134F | S11M/S23K/G55K/H57Y/L69I/ H134F/Q141E/Q165R/A173V/ Y189L/I219L/A263G/V276I/ Q283H/N290Q/Q304R/L341F/ H366E/G368D | | + | +++ | + |
| 1365/1366 | N7L | N7L/S11M/S23K/G55K/H57Y/ L69I/Q141E/Q165R/A173V/ Y189L/I219L/A263G/V276I/ Q283H/N290Q/Q304R/L341F/ H366E/G368D | ++ | ++ | ++ | + |
| 1367/1368 | T8P | T8P/S11M/S23K/G55K/H57Y/ L69I/Q141E/Q165R/A173V/ Y189L/I219L/A263G/V276I/ Q283H/N290Q/Q304R/L341F/ H366E/G368D | + | ++ | ++ | ++ |
| 1369/1370 | N7S | N7S/S11M/S23K/G55K/H57Y/ L69I/Q141E/Q165R/A173V/ Y189L/I219L/A263G/V276I/ Q283H/N290Q/Q304R/L341F/ H366E/G368D | ++ | + | +++ | ++ |
| 1371/1372 | A170G | S11M/S23K/G55K/H57Y/L69I/ Q141E/Q165R/A170G/A173V/ Y189L/I219L/A263G/V276I/ Q283H/N290Q/Q304R/L341F/ H366E/G368D | + | + | ++ | + |
| 1373/1374 | I132V | S11M/S23K/G55K/H57Y/L69I/ I132V/Q141E/Q165R/A173V/ Y189L/I219L/A263G/V276I/ Q283H/N290Q/Q304R/L341F/ H366E/G368D | | + | ++ | + |
| 1375/1376 | K55N | S11M/S23K/G55N/H57Y/L69I/ Q141E/Q165R/A173V/Y189L/ I219L/A263G/V276I/Q283H/ N290Q/Q304R/L341F/H366E/ G368D | + | + | +++ | ++ |
| 1377/1378 | A145S | S11M/S23K/G55K/H57Y/L69I/ Q141E/A145S/Q165R/A173V/ Y189L/I219L/A263G/V276I/ Q283H/N290Q/Q304R/L341F/ H366E/G368D | | ++ | ++ | |
| 1379/1380 | S4E | S4E/S11M/S23K/G55K/H57Y/ L69I/Q141E/Q165R/A173V/ Y189L/I219L/A263G/V276I/ | ++ | + | + | |

TABLE 3-9-continued

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1381/1382 | D3E | D3E/S11M/S23K/G55K/H57Y/L69I/Q141E/Q165R/A173V/Y189L/I219L/A263G/V276I/Q283H/N290Q/Q304R/L341F/H366E/G368D | + | + | +++ | ++ |
| 1383/1384 | F50M | S11M/S23K/F50M/G55K/H57Y/L69I/Q141E/Q165R/A173V/Y189L/I219L/A263G/V276I/Q283H/N290Q/Q304R/L341F/H366E/G368D | | + | ++++ | +++ |
| 1385/1386 | R2W | R2W/S11M/S23K/G55K/H57Y/L69I/Q141E/Q165R/A173V/Y189L/I219L/A263G/V276I/Q283H/N290Q/Q304R/L341F/H366E/G368D | ++ | ++ | ++ | + |
| 1387/1388 | K55E | S11M/S23K/G55E/H57Y/L69I/Q141E/Q165R/A173V/Y189L/I219L/A263G/V276I/Q283H/N290Q/Q304R/L341F/H366E/G368D | + | + | ++ | ++ |
| 1389/1390 | A145G | S11M/S23K/G55K/H57Y/L69I/Q141E/A145G/Q165R/A173V/Y189L/I219L/A263G/V276I/Q283H/N290Q/Q304R/L341F/H366E/G368D | + | ++ | +++ | ++ |
| 1391/1392 | T8G | T8G/S11M/S23K/G55K/H57Y/L69I/Q141E/Q165R/A173V/Y189L/I219L/A263G/V276I/Q283H/N290Q/Q304R/L341F/H366E/G368D | + | + | +++ | + |
| 1393/1394 | R2K | R2K/S11M/S23K/G55K/H57Y/L69I/Q141E/Q165R/A173V/Y189L/I219L/A263G/V276I/Q283H/N290Q/Q304R/L341F/H366E/G368D | + | + | +++ | + |
| 1395/1396 | A47Q | S11M/S23K/A47Q/G55K/H57Y/L69I/Q141E/Q165R/A173V/Y189L/I219L/A263G/V276I/Q283H/N290Q/Q304R/L341F/H366E/G368D | | + | +++ | |
| 1397/1398 | D3S | D3S/S11M/S23K/G55K/H57Y/L69I/Q141E/Q165R/A173V/Y189L/I219L/A263G/V276I/Q283H/N290Q/Q304R/L341F/H366E/G368D | + | + | ++ | + |
| 1399/1400 | K55S | S11M/S23K/G55S/H57Y/L69I/Q141E/Q165R/A173V/Y189L/I219L/A263G/V276I/Q283H/N290Q/Q304R/L341F/H366E/G368D | + | ++ | ++ | +++ |
| 1401/1402 | S4V | S4V/S11M/S23K/G55K/H57Y/L69I/Q141E/Q165R/A173V/Y189L/I219L/A263G/V276I/Q283H/N290Q/Q304R/L341F/H366E/G368D | + | + | +++ | + |
| 1403/1404 | A170Q | S11M/S23K/G55K/H57Y/L69I/Q141E/Q165R/A170Q/A173V/Y189L/I219L/A263G/V276I/Q283H/N290Q/Q304R/L341F/H366E/G368D | + | + | ++ | ++ |
| 1405/1406 | D174E | S11M/S23K/G55K/H57Y/L69I/Q141E/Q165R/A173V/D174E/Y189L/I219L/A263G/V276I/Q283H/N290Q/Q304R/L341F/H366E/G368D | + | ++ | ++ | +++ |
| 1407/1408 | K55P | S11M/S23K/G55P/H57Y/L69I/Q141E/Q165R/A173V/Y189L/I219L/A263G/V276I/Q283H/N290Q/Q304R/L341F/H366E/G368D | ++ | + | ++ | ++ |

TABLE 3-9-continued

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1409/1410 | T8S | T8S/S11M/S23K/G55K/H57Y/ L69I/Q141E/Q165R/A173V/ Y189L/I219L/A263G/V276I/ Q283H/N290Q/Q304R/L341F/ H366E/G368D | ++ | ++ | ++ | +++ |
| 1411/1412 | E287D | S11M/S23K/G55K/H57Y/L69I/ Q141E/Q165R/A173V/Y189L/ I219L/A263G/V276I/Q283H/ E287D/N290Q/Q304R/L341F/ H366E/G368D | | ++ | ++ | + |
| 1413/1414 | D267N | S11M/S23K/G55K/H57Y/L69I/ Q141E/Q165R/A173V/Y189L/ I219L/A263G/D267N/V276I/ Q283H/N290Q/Q304R/L341F/ H366E/G368D | | ++ | ++ | + |
| 1415/1416 | E237Y | S11M/S23K/G55K/H57Y/L69I/ Q141E/Q165R/A173V/Y189L/ I219L/E237Y/A263G/V276I/ Q283H/N290Q/Q304R/L341F/ H366E/G368D | + | + | ++++ | + |
| 1417/1418 | E237R | S11M/S23K/G55K/H57Y/L69I/ Q141E/Q165R/A173V/Y189L/ I219L/E237R/A263G/V276I/ Q283H/N290Q/Q304R/L341F/ H366E/G368D | | + | ++++ | +++ |
| 1419/1420 | Q290K/P295S | S11M/S23K/G55K/H57Y/L69I/ Q141E/Q165R/A173V/Y189L/ I219L/A263G/V276I/Q283H/ N290K/P295S/Q304R/L341F/ H366E/G368D | | + | ++ | + |
| 1421/1422 | Q275S | S11M/S23K/G55K/H57Y/L69I/ Q141E/Q165R/A173V/Y189L/ I219L/A263G/Q275S/V276I/ Q283H/N290Q/Q304R/L341F/ H366E/G368D | | ++ | ++ | ++ |
| 1423/1424 | E237H | S11M/S23K/G55K/H57Y/L69I/ Q141E/Q165R/A173V/Y189L/ I219L/E237H/A263G/V276I/ Q283H/N290Q/Q304R/L341F/ H366E/G368D | | + | +++ | ++ |
| 1425/1426 | H179W | S11M/S23K/G55K/H57Y/L69I/ Q141E/Q165R/A173V/H179W/ Y189L/I219L/A263G/V276I/ Q283H/N290Q/Q304R/L341F/ H366E/G368D | | + | ++ | + |
| 1427/1428 | P295E | S11M/S23K/G55K/H57Y/L69I/ Q141E/Q165R/A173V/Y189L/ I219L/A263G/V276I/Q283H/ N290Q/P295E/Q304R/L341F/ H366E/G368D | + | ++ | ++ | ++ |
| 1429/1430 | L309K | S11M/S23K/G55K/H57Y/L69I/ Q141E/Q165R/A173V/Y189L/ I219L/A263G/V276I/Q283H/ N290Q/Q304R/L309K/L341F/ H366E/G368D | ++ | + | + | |
| 1431/1432 | Q333T | S11M/S23K/G55K/H57Y/L69I/ Q141E/Q165R/A173V/Y189L/ I219L/A263G/V276I/Q283H/ N290Q/Q304R/Q333T/L341F/ H366E/G368D | + | ++ | ++ | ++ |
| 1433/1434 | E237G | S11M/S23K/G55K/H57Y/L69I/ Q141E/Q165R/A173V/Y189L/ I219L/E237G/A263G/V276I/ Q283H/N290Q/Q304R/L341F/ H366E/G368D | | | +++ | + |
| 1435/1436 | S358K | S11M/S23K/G55K/H57Y/L69I/ Q141E/Q165R/A173V/Y189L/ I219L/A263G/V276I/Q283H/ N290Q/Q304R/L341F/S358K/ H366E/G368D | | + | +++ | |
| 1437/1438 | S358R | S11M/S23K/G55K/H57Y/L69I/ Q141E/Q165R/A173V/Y189L/ | | + | +++ | |

TABLE 3-9-continued

Methionine Gamma Lyase Activity (Relative to SEQ ID NO: 1232)[1]

| SEQ ID NO: (nt/aa) | Amino Acid Differences (Relative to SEQ ID NO: 1232) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1439/1440 | L309A | S11M/S23K/G55K/H57Y/L69I/ Q141E/Q165R/A173V/Y189L/ I219L/A263G/V276I/Q283H/ N290Q/Q304R/L309A/L341F/ H366E/G368D | + | ++ | ++ | |
| 1441/1442 | S358C | S11M/S23K/G55K/H57Y/L69I/ Q141E/Q165R/A173V/Y189L/ I219L/A263G/V276I/Q283H/ N290Q/Q304R/L341F/S358C/ H366E/G368D | | | ++ | |
| 1443/1444 | Q275R | S11M/S23K/G55K/H57Y/L69I/ Q141E/Q165R/A173V/Y189L/ I219L/A263G/Q275R/V276I/ Q283H/N290Q/Q304R/L341F/ H366E/G368D | + | ++ | ++ | ++ |
| 1445/1446 | D267R | S11M/S23K/G55K/H57Y/L69I/ Q141E/Q165R/A173V/Y189L/ I219L/A263G/D267R/V276I/ Q283H/N290Q/Q304R/L341F/ H366E/G368D | | + | ++ | |
| 1447/1448 | I322V | S11M/S23K/G55K/H57Y/L69I/ Q141E/Q165R/A173V/Y189L/ I219L/A263G/V276I/Q283H/ N290Q/Q304R/I322V/L341F/ H366E/G368D | | | +++ | ++ |
| 1449/1450 | V383I | S11M/S23K/G55K/H57Y/L69I/ Q141E/Q165R/A173V/Y189L/ I219L/A263G/V276I/Q283H/ N290Q/Q304R/L341F/H366E/ G368D/V383I | | + | ++ | |
| 1451/1452 | E237A | S11M/S23K/G55K/H57Y/L69I/ Q141E/Q165R/A173V/Y189L/ I219L/E237A/A263G/V276I/ Q283H/N290Q/Q304R/L341F/ H366E/G368D | | + | +++ | +++ |
| 1453/1454 | E237K | S11M/S23K/G55K/H57Y/L69I/ Q141E/Q165R/A173V/Y189L/ I219L/E237K/A263G/V276I/ Q283H/N290Q/Q304R/L341F/ H366E/G368D | | + | +++ | +++ |
| 1455/1456 | E237L | S11M/S23K/G55K/H57Y/L69I/ Q141E/Q165R/A173V/Y189L/ I219L/E237L/A263G/V276I/ Q283H/N290Q/Q304R/L341F/ H366E/G368D | + | + | ++++ | ++ |
| 1457/1458 | L236R | S11M/S23K/G55K/H57Y/L69I/ Q141E/Q165R/A173V/Y189L/ I219L/L236R/A263G/V276I/ Q283H/N290Q/Q304R/L341F/ H366E/G368D | + | + | +++ | ++ |
| 1459/1460 | E237V | S11M/S23K/G55K/H57Y/L69I/ Q141E/Q165R/A173V/Y189L/ I219L/E237V/A263G/V276I/ Q283H/N290Q/Q304R/L341F/ H366E/G368D | | | +++ | + |

[1]Levels of increased activity were determined relative to the reference polypeptide of SEQ ID NO: 1232, and defined as follows:
"+" > 0.9;
"++" > 1.1;
"+++" > 1.5; and
"++++" > 3.

Based on the results shown in Table 3-9, SEQ ID NO: 1346 was chosen as the next backbone for evolution. Beneficial mutations identified based on the results shown in Table 3-9 were recombined into the backbone. The variants were assayed as described in Example 2. The differences in assays were that the low pH preincubation was performed at pH 3.5 instead of pH 5.2, the pH in the multi-step challenge was 4.5 instead of 4, and protease concentration was 0.25 g/L, instead of 0.15 g/L. The results are provided in Table 3-10. In this Table, the amino acid differences are indicated relative to SEQ ID NO: 1346.

TABLE 3-10

Methionine Gamma Lyase Activity (Relative to SEQ ID NO: 1346)[1]

| SEQ ID NO: (nt/aa) | Amino Acid Differences (Relative to SEQ ID NO: 1346) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1461/1462 | N5T/L236R/ E237H | N5T/S11M/S23K/G55K/ H57Y/L69I/Q141E/Q165R/ A173V/Y189L/I219L/L223I/ L236R/E237H/A263G/V276I/ H279F/Q283H/N290Q/ A298S/Q304R/L341F/H366E/ G368D | + | | +++ | ++ |
| 1463/1464 | N5T/K55S/ I132V | N5T/S11M/S23K/G55S/H57Y/ L69I/I132V/Q141E/Q165R/ A173V/Y189L/I219L/ L223I/A263G/V276I/H279F/ Q283H/N290Q/A298S/ Q304R/L341F/H366E/G368D | + | ++ | ++ | + |
| 1465/1466 | I132V/L236R/ E237A | S11M/S23K/G55K/H57Y/ L69I/I132V/Q141E/Q165R/ A173V/Y189L/I219L/L223I/ L236R/E237A/A263G/V276I/ H279F/Q283H/N290Q/ A298S/Q304R/L341F/H366E/ G368D | + | | +++ | +++ |
| 1467/1468 | K55P/D267E | S11M/S23K/G55P/H57Y/ L69I/Q141E/Q165R/A173V/ Y189L/I219L/L223I/A263G/ D267E/V276I/H279F/Q283H/ N290Q/A298S/Q304R/ L341F/H366E/G368D | ++ | | ++ | ++ |
| 1469/1470 | N5T/T8S/ L236R/L236R/ E237H/ D267E | N5T/T8S/S11M/S23K/G55K/ H57Y/L69I/Q141E/Q165R/ A173V/Y189L/I219L/L223I/ L236R/E237H/A263G/ D267E/V276I/H279F/Q283H/ N290Q/A298S/Q304R/ L341F/H366E/G368D | | | +++ | ++ |
| 1471/1472 | T8S/K55A/ D267E | T8S/S11M/S23K/G55A/H57Y/ L69I/Q141E/Q165R/A173V/ Y189L/I219L/L223I/ A263G/D267E/V276I/H279F/ Q283H/N290Q/A298S/Q304R/ L341F/H366E/G368D | + | ++ | | ++ |
| 1473/1474 | N5T/F50M | N5T/S11M/S23K/F50M/ G55K/H57Y/L69I/Q141E/ Q165R/A173V/Y189L/I219L/ L223I/A263G/V276I/H279F/ Q283H/N290Q/A298S/ Q304R/L341F/H366E/G368D | | +++ | +++ | +++ |
| 1475/1476 | N5T/T8S/ K55A/I132V/ L236R/E237T | N5T/T8S/S11M/S23K/G55A/ H57Y/L69I/I132V/Q141E/ Q165R/A173V/Y189L/I219L/ L223I/L236R/E237T/ A263G/V276I/H279F/Q283H/ N290Q/A298S/Q304R/ L341F/H366E/G368D | | +++ | +++ | +++ |
| 1477/1478 | T8S/E237H | T8S/S11M/S23K/G55K/H57Y/ L69I/Q141E/Q165R/A173V/ Y189L/I219L/L223I/ E237H/A263G/V276I/H279F/ Q283H/N290Q/A298S/ Q304R/L341F/H366E/G368D | + | +++ | +++ | +++ |
| 1479/1480 | L236R/E237H/ D267E | S11M/S23K/G55K/H57Y/ L69I/Q141E/Q165R/A173V/ Y189L/I219L/L223I/L236R/ E237H/A263G/D267E/ V276I/H279F/Q283H/N290Q/ A298S/Q304R/L341F/ H366E/G368D | + | | +++ | +++ |
| 1481/1482 | F50M/I132V/ D180V/E237H | S11M/S23K/F50M/G55K/ H57Y/L69I/I132V/Q141E/ Q165R/A173V/D180V/ Y189L/I219L/L223I/E237H/ A263G/V276I/H279F/Q283H/ N290Q/A298S/Q304R/ L341F/H366E/G368D | | | +++ | +++ |

TABLE 3-10-continued

Methionine Gamma Lyase Activity (Relative to SEQ ID NO: 1346)[1]

| SEQ ID NO: (nt/aa) | Amino Acid Differences (Relative to SEQ ID NO: 1346) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1483/1484 | I132V | S11M/S23K/G55K/H57Y/ L69I/I132V/Q141E/Q165R/ A173V/Y189L/I219L/L223I/ A263G/V276I/H279F/Q283H/ N290Q/A298S/Q304R/ L341F/H366E/G368D | + | ++ | + | + |
| 1485/1486 | K55P/I132V/ E237H | S11M/S23K/G55P/H57Y/ L69I/I132V/Q141E/Q165R/ A173V/Y189L/I219L/L223I/ E237H/A263G/V276I/H279F/ Q283H/N290Q/A298S/ Q304R/L341F/H366E/G368D | + | + | +++ | +++ |
| 1487/1488 | T8S/K55S/ L236R/E237K/ D267E | T8S/S11M/S23K/G55S/H57Y/ L69I/Q141E/Q165R/A173V/ Y189L/I219L/L223I/ L236R/E237K/A263G/D267E/ V276I/H279F/Q283H/ N290Q/A298S/Q304R/L341F/ H366E/G368D | + |  | +++ | +++ |
| 1489/1490 | K55A/L236R/ E237K | S11M/S23K/G55A/H57Y/ L69I/Q141E/Q165R/A173V/ Y189L/I219L/L223I/L236R/ E237K/A263G/V276I/ H279F/Q283H/N290Q/A298S/ Q304R/L341F/H366E/G368D | + |  | +++ | +++ |
| 1491/1492 | E237H | S11M/S23K/G55K/H57Y/ L69I/Q141E/Q165R/A173V/ Y189L/I219L/L223I/E237H/ A263G/V276I/H279F/ Q283H/N290Q/A298S/Q304R/ L341F/H366E/G368D | + | + | +++ | ++ |
| 1493/1494 | K55S/I132V | S11M/S23K/G55S/H57Y/L69I/ I132V/Q141E/Q165R/ A173V/Y189L/I219L/L223I/ A263G/V276I/H279F/Q283H/ N290Q/A298S/Q304R/ L341F/H366E/G368D |  | + | ++ | + |
| 1495/1496 | F50M | S11M/S23K/F50M/G55K/ H57Y/L69I/Q141E/Q165R/ A173V/Y189L/I219L/L223I/ A263G/V276I/H279F/Q283H/ N290Q/A298S/Q304R/ L341F/H366E/G368D |  | + | +++ | +++ |
| 1497/1498 | E237H/D267E | S11M/S23K/G55K/H57Y/ L69I/Q141E/Q165R/A173V/ Y189L/I219L/L223I/E237H/ A263G/D267E/V276I/ H279F/Q283H/N290Q/A298S/ Q304R/L341F/H366E/G368D | + |  | +++ | ++ |
| 1499/1500 | T8S/K55S | T8S/S11M/S23K/G55S/H57Y/ L69I/Q141E/Q165R/A173V/ Y189L/I219L/L223I/ A263G/V276I/H279F/Q283H/ N290Q/A298S/Q304R/ L341F/H366E/G368D | + | ++ | + | + |
| 1501/1502 | T8S/L236R/ E237K | T8S/S11M/S23K/G55K/H57Y/ L69I/Q141E/Q165R/A173V/ Y189L/I219L/L223I/L236R/ E237K/A263G/V276I/ H279F/Q283H/N290Q/ A298S/Q304R/L341F/H366E/ G368D | + |  | +++ | +++ |
| 1503/1504 | T8S/E237R | T8S/S11M/S23K/G55K/H57Y/ L69I/Q141E/Q165R/A173V/ Y189L/I219L/L223I/ E237R/A263G/V276I/H279F/ Q283H/N290Q/A298S/Q304R/ L341F/H366E/G368D | + | ++ | +++ | +++ |
| 1505/1506 | F50M/L236R/ E237R | S11M/S23K/F50M/G55K/ H57Y/L69I/Q141E/Q165R/ A173V/Y189L/I219L/L223I/ L236R/E237R/A263G/V276I/ |  |  | ++++ | +++ |

TABLE 3-10-continued

Methionine Gamma Lyase Activity (Relative to SEQ ID NO: 1346)[1]

| SEQ ID NO: (nt/aa) | Amino Acid Differences (Relative to SEQ ID NO: 1346) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| | | H279F/Q283H/N290Q/ A298S/Q304R/L341F/H366E/ G368D | | | | |
| 1507/1508 | T8S/I132V/ L236R | T8S/S11M/S23K/G55K/H57Y/ L69I/I132V/Q141E/Q165R/ A173V/Y189L/I219L/ L223I/L236R/A263G/V276I/ H279F/Q283H/N290Q/ A298S/Q304R/L341F/H366E/ G368D | + | ++ | ++ | ++ |
| 1509/1510 | K55S/I132V/ L236R/E237H | S11M/S23K/G55S/H57Y/ L69I/I132V/Q141E/Q165R/ AI73V/Y189L/I219L/L223I/ L236R/E237H/A263G/V276I/ H279F/Q283H/N290Q/ A298S/Q304R/L341F/H366E/ G368D | + | + | ++++ | +++ |
| 1511/1512 | F50M/I132V/ L236R | S11M/S23K/F50M/G55K/ H57Y/L69I/I132V/Q141E/ Q165R/A173V/Y189L/I219L/ L223I/L236R/A263G/V276I/ H279F/Q283H/N290Q/ A298S/Q304R/L341F/H366E/ G368D | | | ++++ | +++ |
| 1513/1514 | T8S/F50M | T8S/S11M/S23K/F50M/G55K/ H57Y/L69I/Q141E/Q165R/ A173V/Y189L/I219L/ L223I/A263G/V276I/H279F/ Q283H/N290Q/A298S/ Q304R/L341F/H366E/G368D | | ++ | ++++ | +++ |
| 1515/1516 | F50M/K55P/ I132V/E237G/ D267E | S11M/S23K/F50M/G55P/ H57Y/L69I/I132V/Q141E/ Q165R/A173V/Y189L/I219L/ L223I/E237G/A263G/D267E/ V276I/H279F/Q283H/ N290Q/A298S/Q304R/L341F/ H366E/G368D/ | | | ++++ | +++ |
| 1517/1518 | T8S/L236R/ E237G | T8S/S11M/S23K/G55K/ H57Y/L69I/Q141E/Q165R/ A173V/Y189L/I219L/L223I/ L236R/E237G/A263G/V276I/ H279F/Q283H/N290Q/ A298S/Q304R/L341F/H366E/ G368D | + | | ++ | ++ |
| 1519/1520 | N5T/T8S/F50M/ I132V | N5T/T8S/S11M/S23K/F50M/ G55K/H57Y/L69I/I132V/ Q141E/Q165R/A173V/ Y189L/I219L/L223I/A263G/ V276I/H279F/Q283H/N290Q/ A298S/Q304R/L341F/ H366E/G368D | | ++ | +++ | +++ |
| 1521/1522 | T8S/F50M/ E237K | T8S/S11M/S23K/F50M/ G55K/H57Y/L69I/Q141E/ Q165R/A173V/Y189L/I219L/ L223I/E237K/A263G/V276I/ H279F/Q283H/N290Q/A298S/ Q304R/L341F/H366E/ G368D | | | ++++ | +++ |
| 1523/1524 | N5T/F50M/ L236R/E237T/ D267E | N5T/S11M/S23K/F50M/ G55K/H57Y/L69I/Q141E/ Q165R/A173V/Y189L/I219L/ L223I/L236R/E237T/A263G/ D267E/V276I/H279F/Q283H/ N290Q/A298S/Q304R/ L341F/H366E/G368D | | | ++++ | +++ |
| 1525/1526 | F50M/I132V/ E237T/D267E | S11M/S23K/F50M/G55K/ H57Y/L69I/I132V/Q141E/ Q165R/A173V/Y189L/I219L/ L223I/E237T/A263G/D267E/ V276I/H279F/Q283H/ N290Q/A298S/Q304R/L341F/ H366E/G368D | | | +++ | +++ |

TABLE 3-10-continued

Methionine Gamma Lyase Activity (Relative to SEQ ID NO: 1346)[1]

| SEQ ID NO: (nt/aa) | Amino Acid Differences (Relative to SEQ ID NO: 1346) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1527/1528 | L236R | S11M/S23K/G55K/H57Y/ L69I/Q141E/Q165R/A173V/ Y189L/I219L/L223I/L236R/ A263G/V276I/H279F/ Q283H/N290Q/A298S/Q304R/ L341F/H366E/G368D | + | | ++ | ++ |
| 1529/1530 | L236R/E237R | S11M/S23K/G55K/H57Y/ L69I/Q141E/Q165R/A173V/ Y189L/I219L/L223I/L236R/ E237R/A263G/V276I/ H279F/Q283H/N290Q/A298S/ Q304R/L341F/H366E/ G368D | + | | +++ | +++ |
| 1531/1532 | T8S/E237R/ D267E | T8S/S11M/S23K/G55K/ H57Y/L69I/Q141E/Q165R/ A173V/Y189L/I219L/L223I/ E237R/A263G/D267E/V276I/ H279F/Q283H/N290Q/A298S/ Q304R/L341F/H366E/ G368D | + | ++ | + | + |
| 1533/1534 | T8S | T8S/S11M/S23K/G55K/H57Y/ L69I/Q141E/Q165R/A173V/ Y189L/I219L/L223I/ A263G/V276I/H279F/Q283H/ N290Q/A298S/Q304R/ L341F/H366E/G368D | + | | + | + |
| 1535/1536 | K55S/L236R/ E237T/D267E | S11M/S23K/G55S/H57Y/ L69I/Q141E/Q165R/A173V/ Y189L/I219L/L223I/L236R/ E237T/A263G/D267E/V276I/ H279F/Q283H/N290Q/ A298S/Q304R/L341F/H366E/ G368D | + | | +++ | +++ |
| 1537/1538 | N5T | N5T/S11M/S23K/G55K/ H57Y/L69I/Q141E/Q165R/ A173V/Y189L/I219L/L223I/ A263G/V276I/H279F/Q283H/ N290Q/A298S/Q304R/ L341F/H366E/G368D | + | ++ | + | ++ |
| 1539/1540 | T8S/F50M/ K55P/I132V/ E237H | T8S/S11M/S23K/F50M/G55P/ H57Y/L69I/I132V/Q141E/ Q165R/A173V/Y189L/I219L/ L223I/E237H/A263G/ V276I/H279F/Q283H/N290Q/ A298S/Q304R/L341F/ H366E/G368D | | | +++ | +++ |
| 1541/1542 | I132V/D267E | S11M/S23K/G55K/H57Y/ L69I/I132V/Q141E/Q165R/ A173V/Y189L/I219L/L223I/ A263G/D267E/V276I/H279F/ Q283H/N290Q/A298S/ Q304R/L341F/H366E/G368D | + | | ++ | ++ |
| 1543/1544 | G263A | S11M/S23K/G55K/H57Y/ L69I/Q141E/Q165R/A173V/ Y189L/I219L/L223I/V276I/ H279F/Q283H/N290Q/ A298S/Q304R/L341F/H366E/ G368D | + | ++ | ++ | +++ |
| 1545/1546 | I223L/D368G | S11M/S23K/G55K/H57Y/ L69I/Q141E/Q165R/A173V/ Y189L/I219L/A263G/V276I/ H279F/Q283H/N290Q/ A298S/Q304R/L341F/H366E | + | +++ | | |
| 1547/1548 | L189Y/D368G | S11M/S23K/G55K/H57Y/ L69I/Q141E/Q165R/A173V/ I219L/L223I/A263G/V276I/ H279F/Q283H/N290Q/ A298S/Q304R/L341F/H366E | ++ | | + | ++ |
| 1549/1550 | H283Q | S11M/S23K/G55K/H57Y/ L69I/Q141E/Q165R/A173V/ YI89L/I219L/L223I/A263G/ V276I/H279F/N290Q/ | + | +++ | | +++ |

TABLE 3-10-continued

Methionine Gamma Lyase Activity (Relative to SEQ ID NO: 1346)[1]

| SEQ ID NO: (nt/aa) | Amino Acid Differences (Relative to SEQ ID NO: 1346) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1551/1552 | K23S/Y57H/ E141Q/I223L | A298S/Q304R/L341F/H366E/ G368D S11M/G55K/L69I/Q165R/ A173V/Y189L/I219L/A263G/ V276I/H279F/Q283H/ N290Q/A298S/Q304R/L341F/ H366E/G368D | ++ | | | |
| 1553/1554 | L219I | S11M/S23K/G55K/H57Y/ L69I/Q141E/Q165R/A173V/ Y189L/L223I/A263G/V276I/ H279F/Q283H/N290Q/ A298S/Q304R/L341F/H366E/ G368D | ++ | + | | |
| 1555/1556 | L219I/I223L/ I276V/F279H/ H283Q/D368G | S11M/S23K/G55K/H57Y/ L69I/Q141E/Q165R/A173V/ Y189L/A263G/N290Q/ A298S/Q304R/L341F/H366E | ++ | + | | ++ |
| 1557/1558 | V173A/G263A/ H283Q/D368G | S11M/S23K/G55K/H57Y/ L69I/Q141E/Q165R/Y189L/ I219L/L223I/V276I/H279F/ N290Q/A298S/Q304R/ L341F/H366E | ++ | +++ | | ++ |
| 1559/1560 | M11S/D368G | S23K/G55K/H57Y/L69I/ Q141E/Q165R/A173V/Y189L/ I219L/L223I/A263G/V276I/ H279F/Q283H/N290Q/ A298S/Q304R/L341F/ H366E | ++ | ++ | | |
| 1561/1562 | Y57H | S11M/S23K/G55K/L69I/ Q141E/Q165R/A173V/Y189L/ I219L/L223I/A263G/V276I/ H279F/Q283H/N290Q/ A298S/Q304R/L341F/H366E/ G368D | ++ | | | |
| 1563/1564 | M11S/K23S/ I276V/F279H/ D368G | G55 K/H57Y/L69I/Q141E/ Q165R/A173V/Y189L/I219L/ L223I/A263G/Q283H/N290Q/ A298S/Q304R/L341F/ H366E | ++ | | | ++ |

[1]Levels of increased activity were determined relative to the reference polypeptide of SEQ ID NO: 1346, and defined as follows:
"+" > 0.9;
"++" > 1.1;
"+++" > 1.5; and
"++++" > 3.

Based on the results shown in Table 3-10, SEQ ID NO: 1488 was chosen as the next backbone for evolution. Variants were constructed on SEQ ID NO: 1488, through saturation mutagenesis at different positions. The variants were assayed as described in Example 2. The only difference was that the low pH preincubation was performed at pH 3.6, instead of pH 5.2. The results are provided in Table 3-11. In this Table, the amino acid differences are indicated relative to SEQ ID NO: 1488.

TABLE 3-11

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP Unchallenged | FIOP 65° C./ Low Met | FIOP 65° C./ pH 4 | FIOP 65° C./ protease |
|---|---|---|---|---|---|---|
| 1565/1566 | T220I | T8S/S11M/S23K/G55S/H57Y/L69I/ Q141E/Q165R/A173V/Y189L/ I219L/T220I/L223I/L236R/E237K/ A263G/D267E/V276I/H279F/ Q283H/N290Q/A298S/Q304R/L341F/ H366E/G368D | | | +++ | |

TABLE 3-11-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP Unchallenged | FIOP 65° C./ Low Met | FIOP 65° C./ pH 4 | FIOP 65° C./ protease |
|---|---|---|---|---|---|---|
| 1567/1568 | L189P | T8S/S11M/S23K/G55S/H57Y/L69I/ Q141E/Q165R/A173V/Y189P/ I219L/L223I/L236R/E237K/A263G/ D267E/V276I/H279F/Q283H/ N290Q/A298S/Q304R/L341F/ H366E/G368D | | | + | |
| 1569/1570 | I93L | T8S/S11M/S23K/G55S/H57Y/L69I/ I93L/Q141E/Q165R/A173V/ Y189L/I219L/L223I/L236R/E237K/ A263G/D267E/V276I/H279F/Q283H/ N290Q/A298S/Q304R/L341F/ H366E/G368D | + | | + | |
| 1571/1572 | L189S | T8S/S11M/S23K/G55S/H57Y/L69I/ Q141E/Q165R/A173V/Y189S/ I219L/L223I/L236R/E237K/A263G/ D267E/V276I/H279F/Q283H/ N290Q/A298S/Q304R/L341F/ H366E/G368D | + | | | |
| 1573/1574 | A221G | T8S/S11M/S23K/G55S/H57Y/L69I/ Q141E/Q165R/A173V/Y189L/ I219L/A221G/L223I/L236R/E237K/ A263G/D267E/V276I/H279F/ Q283H/N290Q/A298S/Q304R/L341F/ H366E/G368D | ++ | | +++ | + |
| 1575/1576 | Y155F | T8S/S11M/S23K/G55S/H57Y/L69I/ Q141E/Y155F/Q165R/A173V/ Y189L/I219L/L223I/L236R/E237K/ A263G/D267E/V276I/H279F/ Q283H/N290Q/A298S/Q304R/L341F/ H366E/G368D | ++ | + | +++ | ++ |
| 1577/1578 | L230V | T8S/S11M/S23K/G55S/H57Y/L69I/ Q141E/Q165R/A173V/Y189L/ I219L/L223I/L230V/L236R/E237K/ A263G/D267E/V276I/H279F/ Q283H/N290Q/A298S/Q304R/L341F/ H366E/G368D | + | ++ | +++ | ++ |
| 1579/1580 | S63G | T8S/S11M/S23K/G55S/H57Y/S63G/ L69I/Q141E/Q165R/A173V/ Y189L/I219L/L223I/L236R/E237K/ A263G/D267E/V276I/H279F/ Q283H/N290Q/A298S/Q304R/L341F/ H366E/G368D | + | ++ | ++ | + |
| 1581/1582 | P284V | T8S/S11M/S23K/G55S/H57Y/L69I/ Q141E/Q165R/A173V/Y189L/ I219L/L223I/L236R/E237K/A263G/ D267E/V276I/H279F/Q283H/ P284V/N290Q/A298S/Q304R/L341F/ H366E/G368D | | | ++ | |
| 1583/1584 | R308K | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/R308K/L341F/ H366E/G368D | ++ | + | | ++ |
| 1585/1586 | P284E | T8S/S11M/S23K/G55S/H57Y/L69I/ Q141E/Q165R/A173V/Y189L/ I219L/L223I/L236R/E237K/A263G/ D267E/V276I/H279F/Q283H/ P284E/N290Q/A298S/Q304R/L341F/ H366E/G368D | ++ | + | +++ | ++ |
| 1587/1588 | A229G | T8S/S11M/S23K/G55S/H57Y/L69I/ Q141E/Q165R/A173V/Y189L/ I219L/L223I/A229G/L236R/E237K/ A263G/D267E/V276I/H279F/ Q283H/N290Q/A298S/Q304R/ L341F/H366E/G368D | + | + | ++ | + |
| 1589/1590 | P284S | T8S/S11M/S23K/G55S/H57Y/L69I/ Q141E/Q165R/A173V/Y189L/ I219L/L223I/L236R/E237K/A263G/ D267E/V276I/H279F/Q283H/ P284S/N290Q/A298S/Q304R/L341F/ H366E/G368D | + | ++ | ++ | + |

TABLE 3-11-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP Unchallenged | FIOP 65° C./ Low Met | FIOP 65° C./ pH 4 | FIOP 65° C./ protease |
|---|---|---|---|---|---|---|
| 1591/1592 | E199W | T8S/S11M/S23K/G55S/H57Y/L69I/ Q141E/Q165R/A173V/Y189L/ E199W/I219L/L223I/L236R/E237K/ A263G/D267E/V276I/H279F/ Q283H/N290Q/A298S/Q304R/ L341F/H366E/G368D | + | | | |
| 1593/1594 | Q362E | T8S/S11M/S23K/G55S/H57Y/ L69I/Q141E/Q165R/A173V/Y189L/ I219L/L223I/L236R/E237K/A263G/ D267E/V276I/H279F/Q283H/ N290Q/A298S/Q304R/L341F/ Q362E/H366E/G368D | ++ | + | ++ | ++ |
| 1595/1596 | R308S | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/R308S/ L341F/H366E/G368D | + | + | ++ | |
| 1597/1598 | A301G | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/A301G/Q304R/ L341F/H366E/G368D | + | + | + | + |
| 1599/1600 | Y300R | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Y300R/Q304R/ L341F/H366E/G368D | ++ | + | | + |
| 1601/1602 | S298R | T8S/S11M/S23K/G55S/H57Y/ L69I/Q141E/Q165R/A173V/Y189L/ I219L/L223I/L236R/E237K/A263G/ D267E/V276I/H279F/Q283H/ N290Q/A298R/Q304R/L341F/H366E/ G368D | + | + | ++++ | ++ |
| 1603/1604 | K395R | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/ H366E/G368D/K395R | ++ | + | ++ | ++ |
| 1605/1606 | G126R | T8S/S11M/S23K/G55S/H57Y/L69I/ G126R/Q141E/Q165R/A173V/ Y189L/I219L/L223I/L236R/E237K/ A263G/D267E/V276I/H279F/ Q283H/N290Q/A298S/Q304R/L341F/ H366E/G368D | + | + | | ++ |
| 1607/1608 | I69V | T8S/S11M/S23K/G55S/H57Y/L69V/ Q141E/Q165R/A173V/Y189L/ I219L/L223I/L236R/E237K/A263G/ D267E/V276I/H279F/Q283H/ N290Q/A298S/Q304R/L341F/H366E/ G368D | ++ | + | | ++ |
| 1609/1610 | K395A | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/H366E/ G368D/K395A | ++ | + | +++ | + |
| 1611/1612 | R233Q | T8S/S11M/S23K/G55S/H57Y/L69I/ Q141E/Q165R/A173V/Y189L/ I219L/L223I/R233Q/L236R/E237K/ A263G/D267E/V276I/H279F/ Q283H/N290Q/A298S/Q304R/L341F/ H366E/G368D | ++ | ++ | +++ | ++ |
| 1613/1614 | D384G | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/H366E/ G368D/D384G | ++ | ++ | | + |

TABLE 3-11-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP Unchallenged | FIOP 65° C./ Low Met | FIOP 65° C./ pH 4 | FIOP 65° C./ protease |
|---|---|---|---|---|---|---|
| 1615/1616 | R233V | T8S/S11M/S23K/G55S/H57Y/L69I/ Q141E/Q165R/A173V/Y189L/ I219L/L223I/R233V/L236R/E237K/ A263G/D267E/V276I/H279F/ Q283H/N290Q/A298S/Q304R/L341F/ H366E/G368D | + | + | | ++ |
| 1617/1618 | E323S | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/E323S/L341F/ H366E/G368D | | + | | |
| 1619/1620 | A396Q | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/H366E/ G368D/A396Q | + | + | + | ++ |
| 1621/1622 | S298G | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298G/Q304R/L341F/ H366E/G368D | ++ | + | ++++ | ++ |
| 1623/1624 | R282Q | T8S/S11M/S23K/G55S/H57Y/L69I/ Q141E/Q165R/A173V/Y189L/ I219L/L223I/L236R/E237K/A263G/ D267E/V276I/H279F/R282Q/ Q283H/N290Q/A298S/Q304R/L341F/ H366E/G368D | + | + | ++ | + |
| 1625/1626 | L254A | T8S/S11M/S23K/G55S/H57Y/L69I/ Q141E/Q165R/A173V/Y189L/ I219L/L223I/L236R/E237K/L254A/ A263G/D267E/V276I/H279F/ Q283H/N290Q/A298S/Q304R/L341F/ H366E/G368D | | | | |
| 1627/1628 | A175V | T8S/S11M/S23K/G55S/H57Y/L69I/ Q141E/Q165R/A173V/A175V/ Y189L/I219L/L223I/L236R/E237K/ A263G/D267E/V276I/H279F/ Q283H/N290Q/A298S/Q304R/L341F/ H366E/G368D | ++ | + | ++ | ++ |
| 1629/1630 | A365R | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/A365R/ H366E/G368D | + | + | ++++ | |
| 1631/1632 | A396R | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/H366E/ G368D/A396R | + | + | ++ | + |
| 1633/1634 | R308L | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/R308L/L341F/ H366E/G368D | + | + | +++ | + |
| 1635/1636 | A398G | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/H366E/ G368D/A398G | + | + | ++ | ++ |
| 1637/1638 | S298C | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298C/Q304R/L341F/H366E/ G368D | + | + | ++++ | + |

TABLE 3-11-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP Unchallenged | FIOP 65° C./ Low Met | FIOP 65° C./ pH 4 | FIOP 65° C./ protease |
|---|---|---|---|---|---|---|
| 1639/1640 | E141V | T8S/S11M/S23K/G55S/H57Y/L69I/ Q141V/Q165R/A173V/Y189L/ I219L/L223I/L236R/E237K/A263G/ D267E/V276I/H279F/Q283H/ N290Q/A298S/Q304R/L341F/ H366E/G368D | + | + | ++++ | + |
| 1641/1642 | S253G | T8S/S11M/S23K/G55S/H57Y/L69I/ Q141E/Q165R/A173V/Y189L/ I219L/L223I/L236R/E237K/S253G/ A263G/D267E/V276I/H279F/ Q283H/N290Q/A298S/Q304R/ L341F/H366E/G368D | + | + | ++++ | + |
| 1643/1644 | N6P | N6P/T8S/S11M/S23K/G55S/H57Y/ L69I/Q141E/Q165R/A173V/ Y189L/I219L/L223I/L236R/E237K/ A263G/D267E/V276I/H279F/ Q283H/N290Q/A298S/Q304R/ L341F/H366E/G368D | + | + | +++ | + |
| 1645/1646 | R233G | T8S/S11M/S23K/G55S/H57Y/ L69I/Q141E/Q165R/A173V/Y189L/ I219L/L223I/R233G/L236R/E237K/ A263G/D267E/V276I/H279F/ Q283H/N290Q/A298S/Q304R/ L341F/H366E/G368D | + | ++ | +++ | + |
| 1647/1648 | D384Q | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/ H366E/G368D/D384Q | ++ | + | +++ | + |
| 1649/1650 | A82C | T8S/S11M/S23K/G55S/H57Y/L69I/ A82C/Q141E/Q165R/A173V/ Y189L/I219L/L223I/L236R/E237K/ A263G/D267E/V276I/H279F/ Q283H/N290Q/A298S/Q304R/ L341F/H366E/G368D | + | + | ++++ | + |
| 1651/1652 | R233S | T8S/S11M/S23K/G55S/H57Y/L69I/ Q141E/Q165R/A173V/Y189L/ I219L/L223I/R233S/L236R/E237K/ A263G/D267E/V276I/H279F/ Q283H/N290Q/A298S/Q304R/ L341F/H366E/G368D | + | + |  | ++ |
| 1653/1654 | R304K | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304K/L341F/ H366E/G368D | ++ | ++ |  | + |
| 1655/1656 | R233M | T8S/S11M/S23K/G55S/H57Y/L69I/ Q141E/Q165R/A173V/Y189L/ I219L/L223I/R233M/L236R/E237K/ A263G/D267E/V276I/H279F/ Q283H/N290Q/A298S/Q304R/ L341F/H366E/G368D | + | + | ++ | ++ |
| 1657/1658 | G9R | T8S/G9R/S11M/S23K/G55S/H57Y/ L69I/Q141E/Q165R/A173V/ Y189L/I219L/L223I/L236R/E237K/ A263G/D267E/V276I/H279F/ Q283H/N290Q/A298S/Q304R/ L341F/H366E/G368D | + | + |  | + |
| 1659/1660 | A301S | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/A301S/Q304R/L341F/ H366E/G368D |  | + | +++ |  |
| 1661/1662 | R304V | T8S/S11M/S23K/G55S/H57Y/L6 Q141E/Q165R/A173V/Y189L/9I/ I219L/L223I/L236R/E237K/A263G/ D267E/V276I/H279F/Q283H/ N290Q/A298S/Q304V/L341F/ H366E/G368D | + | + | ++++ |  |

TABLE 3-11-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP Unchallenged | FIOP 65° C./ Low Met | FIOP 65° C./ pH 4 | FIOP 65° C./ protease |
|---|---|---|---|---|---|---|
| 1663/1664 | S298N | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298N/Q304R/L341F/ H366E/G368D | + | + | | |
| 1665/1666 | D384A | T8S/S11M/S23K/G55S/H57Y/L69I/ Q141E/Q165R/A173V/Y189L/ I219L/L223I/L236R/E237K/A263G/ D267E/V276I/H279F/Q283H/ N290Q/A298S/Q304R/L341F/ H366E/G368D/D384A | + | + | +++ | + |

[1]Levels of increased activity were determined relative to the reference polypeptide of SEQ ID NO: 1488, and defined as follows:
"+" > 0.9;
"++" > 1.1;
"+++" > 1.5; and
"++++" > 3.

Beneficial mutations identified based on the results shown in Table 3-11 were recombined into the backbone SEQ ID NO: 1488. The variants were assayed as described in Example 2. The differences in assays were that the low pH preincubation was performed at pH 3.5, instead of pH 5.2, and the protease concentration in the multi-step heat-low pH-protease challenge was 1.5 g/L, instead of 0.15 g/L. The results are provided in Table 3-12. In this Table, the amino acid differences are indicated relative to SEQ ID NO: 1488.

TABLE 3-12

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1667/1668 | R233S/Q362E | T8S/S11M/S23K/G55S/H57Y/ L69I/Q141E/Q165R/A173V/Y189L/ I219L/L223I/R233S/L236R/ E237K/A263G/D267E/V276I/ H279F/Q283H/N290Q/A298S/ Q304R/L341F/Q362E/H366E/ G368D | + | | ++ | |
| 1669/1670 | R233M/S298N/ Q362E | T8S/S11M/S23K/G55S/H57Y/ L69I/Q141E/Q165R/A173V/Y189L/ I219L/L223I/R233M/L236R/ E237K/A263G/D267E/V276I/ H279F/Q283H/N290Q/A298N/ Q304R/L341F/Q362E/H366E/ G368D | + | | ++ | + |
| 1671/1672 | S298N/Q362E/ D384G | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298N/Q304R/ L341F/Q362E/H366E/G368D/ D384G | + | | + | ++ |
| 1673/1674 | A398G | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298S/Q304R/ L341F/H366E/G368D/A398G | + | | + | ++ |
| 1675/1676 | S298R | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298R/Q304R/ L341F/H366E/G368D | + | + | + | +++ |

TABLE 3-12-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1677/1678 | L230V/R233Q/ D384G/K395R/ A398G | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/Q283H/N290Q/ A298S/Q304R/L341F/H366E/ G368D/D384G/K395R/A398G | + | ++++ | ++ | ++ |
| 1679/1680 | L230V/Q362E/ K395R | T8S/S11M/S23K/G55S/H57Y/ L69I/Q141E/Q165R/A173V/Y189L/ I219L/L223I/L230V/L236R/ E237K/A263G/D267E/V276I/ H279F/Q283H/N290Q/A298S/ Q304R/L341F/Q362E/H366E/ G368D/K395R | + | ++++ | ++ | ++ |
| 1681/1682 | L230V/R233Q/ R308K/D384G/ K395R | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/Q283H/N290Q/ A298S/Q304R/R308K/L341F/ H366E/G368D/D384G/K395R | + | ++++ | ++ | ++ |
| 1683/1684 | L230V/R233M/ S298N/A301S/ K395R | T8S/S11M/S23K/G55S/H57Y/ L69I/Q141E/Q165R/A173V/Y189L/ I219L/L223I/L230V/R233M/ L236R/E237K/A263G/D267E/ V276I/H279F/Q283H/N290Q/ A298N/A301S/Q304R/L341F/ H366E/G368D/K395R | + | ++++ | +++ | ++ |
| 1685/1686 | L230V/R233M/ D384G/K395R | T8S/S11M/S23K/G55S/H57Y/ L69I/Q141E/Q165R/A173V/Y189L/ I219L/L223I/L230V/R233M/ L236R/E237K/A263G/D267E/ V276I/H279F/Q283H/N290Q/ A298S/Q304R/L341F/H366E/ G368D/D384G/K395R | + | ++++ | ++ | + |
| 1687/1688 | R233Q/D384G/ K395R | T8S/S11M/S23K/G55S/H57Y/ L69I/Q141E/Q165R/A173V/Y189L/ I219L/L223I/R233Q/L236R/ E237K/A263G/D267E/V276I/ H279F/Q283H/N290Q/A298S/ Q304R/L341F/H366E/G368D/ D384G/K395R | + | ++++ | ++ | |
| 1689/1690 | R233S/D384G/ K395R | T8S/S11M/S23K/G55S/H57Y/ L69I/Q141E/Q165R/A173V/Y189L/ I219L/L223I/R233S/L236R/ E237K/A263G/D267E/V276I/ H279F/Q283H/N290Q/A298S/ Q304R/L341F/H366E/G368D/ D384G/K395R | + | ++++ | ++ | |
| 1691/1692 | R233M/Q362E/ K395R/A398G | T8S/S11M/S23K/G55S/H57Y/ L69I/Q141E/Q165R/A173V/Y189L/ I219L/L223I/R233M/L236R/ E237K/A263G/D267E/V276I/ H279F/Q283H/N290Q/A298S/ Q304R/L341F/Q362E/H366E/ G368D/K395R/A398G | + | ++++ | ++ | + |
| 1693/1694 | L230V | T8S/S11M/S23K/G55S/H57Y/ L69I/Q141E/Q165R/A173V/Y189L/ I219L/L223I/L230V/L236R/ E237K/A263G/D267E/V276I/ H279F/Q283H/N290Q/A298S/ Q304R/L341F/H366E/G368D | + | ++ | + | ++ |
| 1695/1696 | L230V/R233Q/ A281V | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/A281V/Q283H/ N290Q/A298S/Q304R/L341F/ H366E/G368D | + | ++++ | ++ | ++ |

TABLE 3-12-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| 1697/1698 | L189M/L230V/ R233S/S298N/ K395R/A398G | T8S/S11M/S23K/G55S/H57Y/ L69I/Q141E/Q165R/A173V/Y189M/ I219L/L223I/L230V/R233S/ L236R/E237K/A263G/D267E/ V276I/H279F/Q283H/N290Q/ A298N/Q304R/L341F/H366E/ G368D/K395R/A398G | | ++++ | | ++ |
| 1699/1700 | L230V/R233Q/ S298N/Q362E | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/Q283H/N290Q/ A298N/Q304R/L341F/Q362E/ H366E/G368D | + | | +++ | +++ |
| 1701/1702 | L230V/R233M/ Q362E/K395R | T8S/S11M/S23K/G55S/H57Y/ L69I/Q141E/Q165R/A173V/Y189L/ I219L/L223I/L230V/R233M/ L236R/E237K/A263G/D267E/ V276I/H279F/Q283H/N290Q/ A298S/Q304R/L341F/Q362E/ H366E/G368D/K395R | + | ++++ | ++ | ++ |
| 1703/1704 | R233M/S298N/ R308K/D384G/ K395R | T8S/S11M/S23K/G55S/H57Y/ L69I/Q141E/Q165R/A173V/Y189L/ I219L/L223I/R233M/L236R/ E237K/A263G/D267E/V276I/ H279F/Q283H/N290Q/A298N/ Q304R/R308K/L341F/H366E/ G368D/D384G/K395R | + | ++++ | ++ | |
| 1705/1706 | R233S/Q362E/ K395R | T8S/S11M/S23K/G55S/H57Y/ L69I/Q141E/Q165R/A173V/Y189L/ I219L/L223I/R233S/L236R/ E237K/A263G/D267E/V276I/ H279F/Q283H/N290Q/A298S/ Q304R/L341F/Q362E/H366E/ G368D/K395R | + | ++++ | +++ | |
| 1707/1708 | S298Y/A301S | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298Y/A301S/ Q304R/L341F/H366E/G368D | + | ++ | + | + |
| 1709/1710 | R233M | T8S/S11M/S23K/G55S/H57Y/ L69I/Q141E/Q165R/A173V/Y189L/ I219L/L223I/R233M/L236R/ E237K/A263G/D267E/V276I/ H279F/Q283H/N290Q/A298S/ Q304R/L341F/H366E/G368D | + | | ++ | + |
| 1711/1712 | D384G/A398G | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298S/Q304R/ L341F/H366E/G368D/D384G/ A398G | + | ++ | ++ | ++ |
| 1713/1714 | K395R/A398G | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298S/Q304R/ L341F/H366E/G368D/K395R/ A398G | + | ++++ | + | |
| 1715/1716 | S298N/A301S/ R308K/D384G | T8S/S11M/S23K/G55S/H57Y/ L69I/Q141E/Q165R/A173V/Y189L/ I219L/L223I/L236R/E237 A263G/D267E/V276I/H27K/9F/ Q283H/N290Q/A298N/A301S/ Q304R/R308K/L341F/H366E/ G368D/D384G | + | + | + | + |
| 1717/1718 | R233Q/S298R/ Q362E | T8S/S11M/S23K/G55S/H57Y/ L69I/Q141E/Q165R/A173V/Y189L/ I219L/L223I/R233Q/L236R/ E237K/A263G/D267E/V276I/ | + | | ++ | ++ |

TABLE 3-12-continued

Methionine Gamma Lyase Activity (Relative to SEQ ID NO: 1488)[1]

| SEQ ID NO: (nt/aa) | Amino Acid Differences (Relative to SEQ ID NO: 1488) | Amino Acid Differences (Relative to SEQ ID NO: 2) | FIOP 65° C./ Low Met | FIOP 65° C./ pH 4 | FIOP 65° C./ protease | FIOP 65° C./ pH 4/ Protease |
|---|---|---|---|---|---|---|
| | | H279F/Q283H/N290Q/A298R/ Q304R/L341F/Q362E/H366E/ G368D | | | | |
| 1719/1720 | L230V/R233Q/ S298R/A301S/ Q362E/D384G/ K395R | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/Q283H/N290Q/ A298R/A301S/Q304R/L341F/ Q362E/H366E/G368D/D384G/ K395R | + | ++++ | ++ | +++ |
| 1721/1722 | L230V/R233S/ S298N/A301S/ Q362E/D384G/ K395R | T8S/S11M/S23K/G55S/H57Y/ L69I/Q141E/Q165R/A173V/Y189L/ I219L/L223I/L230V/R233S/ L236R/E237K/A263G/D267E/ V276I/H279F/Q283H/N290Q/ A298N/A301S/Q304R/L341F/ Q362E/H366E/G368D/D384G/ K395R | + | ++++ | +++ | + |
| 1723/1724 | Q362E/D384G | T8S/S11M/S23K/G55S/H57Y/ L69I/Q141E/Q165R/A173V/Y189L/ I219L/L223I/L236R/E237K/ A263G/D267E/V276I/H279F/ Q283H/N290Q/A298S/Q304R/ L341F/Q362E/H366E/G368D/ D384G | + | + | ++ | ++ |
| 1725/1726 | R233Q | T8S/S11M/S23K/G55S/H57Y/ L69I/Q141E/Q165R/A173V/Y189L/ I219L/L223I/R233Q/L236R/ E237K/A263G/D267E/V276I/ H279F/Q283H/N290Q/A298S/ Q304R/L341F/H366E/G368D | + | | ++ | + |
| 1727/1728 | R233G/K395R | T8S/S11M/S23K/G55S/H57Y/ L69I/Q141E/Q165R/A173V/Y189L/ I219L/L223I/R233G/L236R/ E237K/A263G/D267E/V276I/ H279F/Q283H/N290Q/A298S/ Q304R/L341F/H366E/G368D/ K395R | + | ++++ | ++ | |
| 1729/1730 | R233Q/S298N/ A301S/Q362E | T8S/S11M/S23K/G55S/H57Y/ L69I/Q141E/Q165R/A173V/Y189L/ I219L/L223I/R233Q/L236R/ E237K/A263G/D267E/V276I/ H279F/Q283H/N290Q/298N/ A301S/Q304R/L341F/Q362E/ H366E/G368D | + | ++ | ++ | ++ |
| 1731/1732 | L230V/R233Q/ S298R/A301S/ K395R | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/Q283H/N290Q/ A298R/A301S/Q304R/L341F/ H366E/G368D/K395R | + | ++++ | ++ | +++ |
| 1733/1734 | L230V/R233Q/ S298N/A301S/ K395R | T8S/S11M/S23K/G55S/H57Y/ L69I/Q141E/Q165R/A173V/Y189L/ I219L/L223I/L230V/R233Q/ L236R/E237K/A263G/D267E/ V276I/H279F/Q283H/N290Q/ A298N/A301S/Q304R/L341F/ H366E/G368D/K395R | + | ++++ | ++ | ++ |

[1]Levels of increased activity were determined relative to the reference polypeptide of SEQ ID NO: 1488, and defined as follows:
"+" > 0.9;
"++" > 1.1;
"+++" > 1.5; and
"++++" > 3.

Example 4

In Vivo Characterization of SEQ ID NO: 1706

The Cynomolgus monkey is a common pharmacokinetic and pharmacodynamic model to assess the properties of small molecules and proteins, such as the PeMGL variant SEQ ID NO: 1706. Ten male cynomolgus monkeys (non-naïve) from the Covance stock colony were acclimated to study conditions for two days prior to dose administration. During acclimation and the test period, animals were housed in stainless steel cages. Animals were commingled, as applicable, prior to administration of the methionine gamma lyase polypeptide of SEQ ID NO: 1706; animals were not commingled for at least 24 hours after test article administration to allow monitoring of any test article-related effects. Animals were individually housed for study-related procedures or behavioral or health reasons. Environmental controls for the animal room were set to maintain a temperature of 18 to 26° C. and a 12-hour light/12-hour dark cycle. As necessary the 12-hour dark cycle was interrupted to accommodate study procedures. Humidity was not monitored.

On days of dose administration, all animals were fasted overnight prior to dosing. All animals received approximately 25 g of peptone (Casein Digest, Difco™; casein peptone digest containing 2.7% total methionine, of which 2.3% (575 mg) was in free form), given via oral gavage as a suspension with water (45 mL/animal), to ensure equal protein delivery. The test group of five animals received 370 mg/kg of PeMGL (SEQ ID NO: 1706) via oral gavage as a suspension with water (2-2.5 mL/animal). The control group of five animals received approximately 2.5 mL of potassium phosphate (50 mM) administered via oral gavage. The normal portion of feed (5L4F PMI Lab FiberPlus Monkey Diet 20; PMI Nutrition) was offered to all animals approximately 8 hours post-dose on dosing days; the total fasting time did not exceed 24 hours. For environmental and psychological enrichment, various cage and/or food enrichment (that did not require analysis) were offered in accordance with the applicable SOPs. Diets were supplemented with appropriate treats (that did not require analysis) in accordance with Covance's SOPs. Blood (approximately 0.5 mL) was collected via a femoral vein via syringe and needle and transferred into tubes containing $K_2EDTA$ from each animal. This was performed at approximately 88-102 and 28-44 minutes (deviation) prior to dose administration and at approximately 0.083, 0.25, 0.5, 1, 2, 4, 8, 12, and 24 hours post-dose. Blood was centrifuged to obtain plasma, and plasma samples were analyzed for levels of methionine, phenylalanine, and tyrosine using LC-MS, against a standard curve for each measure.

Administration of peptone 'meal' by oral gavage resulted in an increase in methionine levels above the fasting level, to a maximum of approximately 60 µM at the 2 hour time point, when dosed with vehicle control (50 mM potassium phosphate). Treatment with the methionine gamma lyase polypeptide of SEQ ID NO: 1706 immediately following the peptone 'meal' suppressed the methionine spike to approximately 6 µM. Statistical analysis of the normalized peak area demonstrated a significant inhibition of the methionine spike at both 2 and 4 hours following treatment ($p<0.0001$, $n=10$). Administration of peptone 'meal' by oral gavage resulted in an increase in both phenylalanine and tyrosine levels which peaked between 2 and 4 hours. Treatment with the polypeptide of SEQ ID NO:1706 (370 mg/kg) immediately following the peptone 'meal' had no effect on the spike observed.

Example 5

In Vivo Dose Response Characterization of Engineered Methionine Gamma Lyase Polypeptide of SEQ ID NO: 1706

Non-naïve male Cynomolgus monkeys were utilized for additional in vivo SEQ ID NO: 1706 dose response studies. The housing and feeding regimen pre- and post-dose administration, peptone 'meal' administration, test article administration, blood sample collection and preparation, and analysis were the same as described in Example 4. The engineered methionine gamma lyase polypeptide of SEQ ID NO: 1706 was administered at 370 mg/kg to bridge with the prior study, as well as at 185 mg/kg, 92.5 mg/kg and 37 mg/kg. The study design in described in Table 5-1.

TABLE 5-1

| | | | | | | | | | |
|---|---|---|---|---|---|---|---|---|---|
| Study Day | Test Item (TI) Identity | DS | DS Dose Volume (mL/NHP) | Group No. | Treatment | TI Dose Level (mg/kg) | TO Conc (mg/mL) | TI Dose Volume (mL/kg) | Cynomolgus ID |
| 1 | SEQ ID NO: 1706 | Casein Digest Peptone | 30 | 1 | Control/Vehicle | 0 | 0 | 2 | 1001A-1608599 A 1002A-1608445 B 1003A-1610655 C |
| | | | 30 | 2 | Low Dose | 37 | 18.5 | 2 | 2001A-1610285 D 2002A-1609321 E 2003A-1609831 F |
| | | | 30 | 3 | Low/Mid Dose | 92.5 | 46.25 | 2 | 3001A-1607217 G 3002A-1609693 H |
| | | | 30 | 4 | Mid Dose | 185 | 92.5 | 2 | 4001A-1608553 1 4002A-1608537 J |

TABLE 5-1-continued

In vivo Dose Response Study Design for SEQ ID NO: 1706

| Study Day | Test Item (TI) Identity | DS | DS Dose Volume (mL/NHP) | Group No. | Treatment | TI Dose Level (mg/kg) | TO Conc (mg/mL) | TI Dose Volume (mL/kg) | Cynomolgus ID |
|---|---|---|---|---|---|---|---|---|---|
| | | | 30 | 5 | High Dose | 370 | 185 | 2 | 5001A-1607131 K 5002A-1610503 L |
| 8 | SEQ ID NO: 1706 | Casein Digest Peptone | 30 | 1 | Mid Dose | 185 | 92.5 | 2 | 1001A-1608599 A 1002A-1608445 B |
| 15 | SEQ ID NO: 1706 | Casein Digest Peptone | 30 | 1 | Low/Mid Dose | 92.5 | 46.25 | 2 | 1001A-1608599 A 1002A-1608445 B 1003A-1610655 C |
| | | | 30 | 2 | Mid Dose | 185 | 92.5 | 2 | 2001A-1610285 D 2002A-1609321 E 2003A-1609831 F |
| | | | 30 | 3 | High Dose | 370 | 185 | 2 | 3001A-1607217 G 3002A-1609693 H |
| | | | 30 | 4 | Control/Vehicle | 0 | 0 | 2 | 4001A-1608553 1 4102B-1609173 M |
| | | | 30 | 5 | Low Dose | 37 | 18.5 | 2 | 5001A-1607131 K 5002A-1610503 L |

Administration of peptone 'meal' by oral gavage resulted in an increase in methionine levels above the fasting level, to a maximum of approximately 30 µg/mL at the 2 hour time point, when dosed with vehicle control (50 mM potassium phosphate). Treatment with the engineered methionine gamma lyase polypeptide of SEQ ID NO: 1706 immediately following the peptone 'meal' significantly suppressed the methionine spike in all doses tested. The lowest dose (37 mg/kg) resulted in 65% reduction of plasma methionine ($p<0.0001$); low/mid dose (92.5 mg/kg) resulted in 86% reduction of plasma methionine ($p<0.0001$); mid dose (185 mg/kg) resulted in 92% reduction of plasma methionine ($p<0.0001$), while the high dose (370 mg/kg) resulted in 96% reduction of plasma methionine ($p<0.0001$). As in the Example 4, administration of the methionine gamma lyase polypeptide of SEQ ID NO: 1706 had no effect on plasma phenylalanine or tyrosine.

Example 6

Pharmacodynamic (PD) Study of Engineered Methionine Gamma Lyase of SEQ ID NO: 1706 in the Tg-1278T Cbs−/− Mouse Model Twenty-four Tg-I278T Cbs$^{-/-}$ mice (mixed sex, 3-8 months old) were switched from Standard Protein Diet (PicoLab Verified-751F (5V75), 6% methionine; LabDiet Advanced Protocol) to Low Methionine Diet (LMD; TD.110591, 0.5% methionine; Envigo) for seven days prior to study start. Mice had free access to LMD and water throughout the study. Mice were randomly assigned to treatment or vehicle groups, and then further randomized into subgroups for blood collection (45 minutes, 4 hours, and 24 hours). At time zero, the mice were given approximately 57.6 mg of whey (Grass Fed Whey Protein, BN Labs Lot #U0637AL; whey protein powder containing 1.75% w/w methionine), by oral gavage as a suspension in water (200 µL/animal). Immediately following the whey protein meal, the mice received either vehicle (50 mM potassium phosphate) or engineered methionine gamma lyase of SEQ ID NO: 1706 (148 mg/kg diluted in vehicle) via oral gavage (50 µL/animal). Blood was drawn through the submandibular vein at the scheduled time points post dose (i.e., 45 min, 4 hrs, 24 hrs). Samples were processed to serum and then analyzed by LC-MS to determine methionine (Met) and homocysteine (tHcy) levels using a standard curve (range: 3-399 µM; LOQ: 2 µM) for each measure.

Figure 1B:
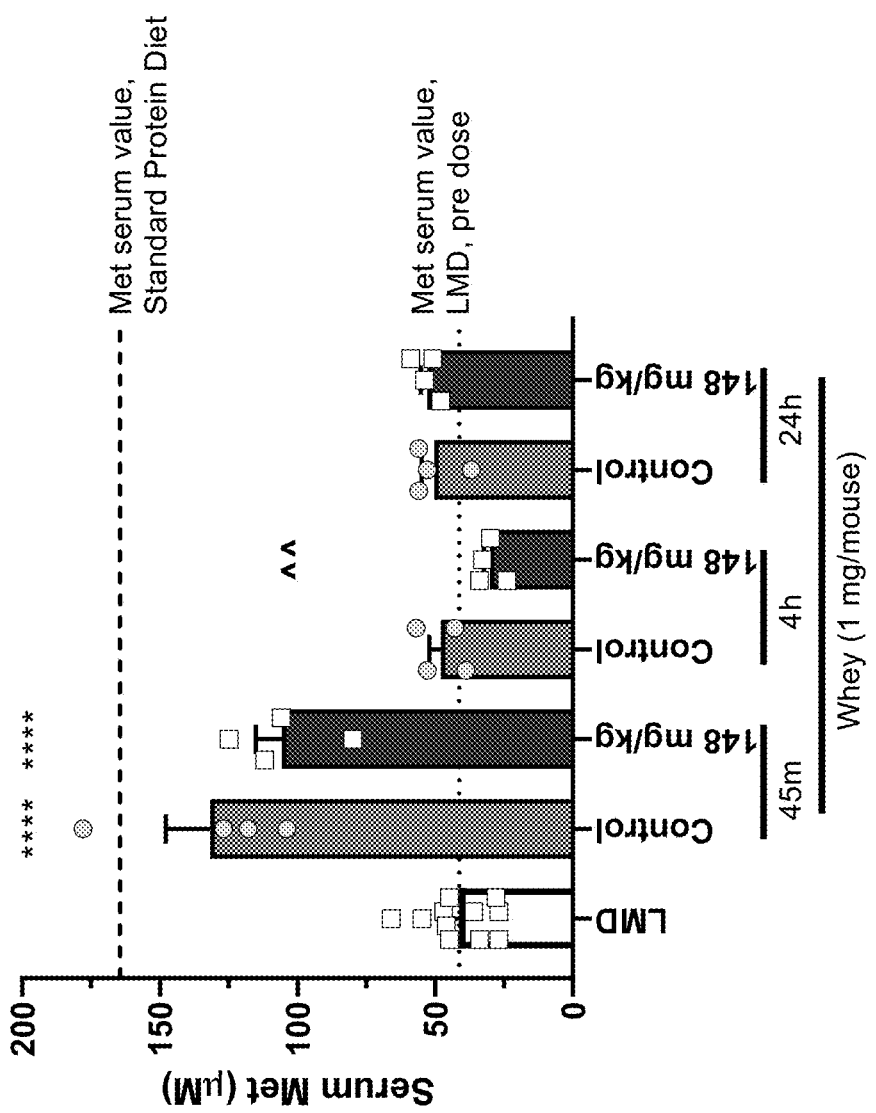

Following administration of the whey protein meal and vehicle, the animals had significant increases in serum Met (45 minutes) and tHcy (all timepoints). Treatment with engineered methionine gamma lyase of SEQ ID NO: 1706 immediately following the whey 'meal' significantly suppressed the tHcy spike at 45 minutes and 4 hours (28% ($p<0.05$) and 31% ($p<0.01$), respectively, as assessed by unpaired t-test; FIG. 1A). Engineered methionine gamma lyase of SEQ ID NO: 1706 also suppressed the Met spike at 45 minutes and 4 hours (20% (not significant) and 37% ($p<0.01$), respectively; FIG. 1B).

Example 7

Pharmacodynamic (PD) Dose Response Study of Engineered Methionine Gamma Lyase of SEQ ID NO: 1706 in the Tg-1278T Cbs$^{-/-}$ Mouse Model Twenty-two Tg-1278T Cbs$^{-/-}$ mice (mixed sex, 3-8 months old) were switched from Standard Protein Diet (PicoLab Verified-75IF (5V75), 6% methionine; LabDiet Advanced Protocol) to Low Methionine Diet (LMD; TD.110591, 0.5% methionine; Envigo) for seven days prior to study start. Mice had free access to low methionine diet and water throughout the study. Mice were randomly assigned to treatment or vehicle groups. At time zero, the mice were given approximately 57.6 mg of whey (Grass Fed Whey Protein, BN Labs Lot #U0637AL; whey protein powder containing 1.75% w/w methionine), by oral gavage as a suspension in water (200 µL/animal). Immediately following the whey protein meal, the mice received either vehicle (50 mM potassium phosphate) or engineered methionine gamma lyase of SEQ ID NO: 1706 (37, 74, or 148 mg/kg diluted in vehicle) via oral gavage (50 µL/animal). Blood was drawn through the submandibular vein at 4 hours post dose. Samples were processed to serum and then analyzed by LC-MS to determine methionine and homocysteine levels using a standard curve (range: 3-399 µM; LOQ: 2 µM) for each measure.

Figure 2A:
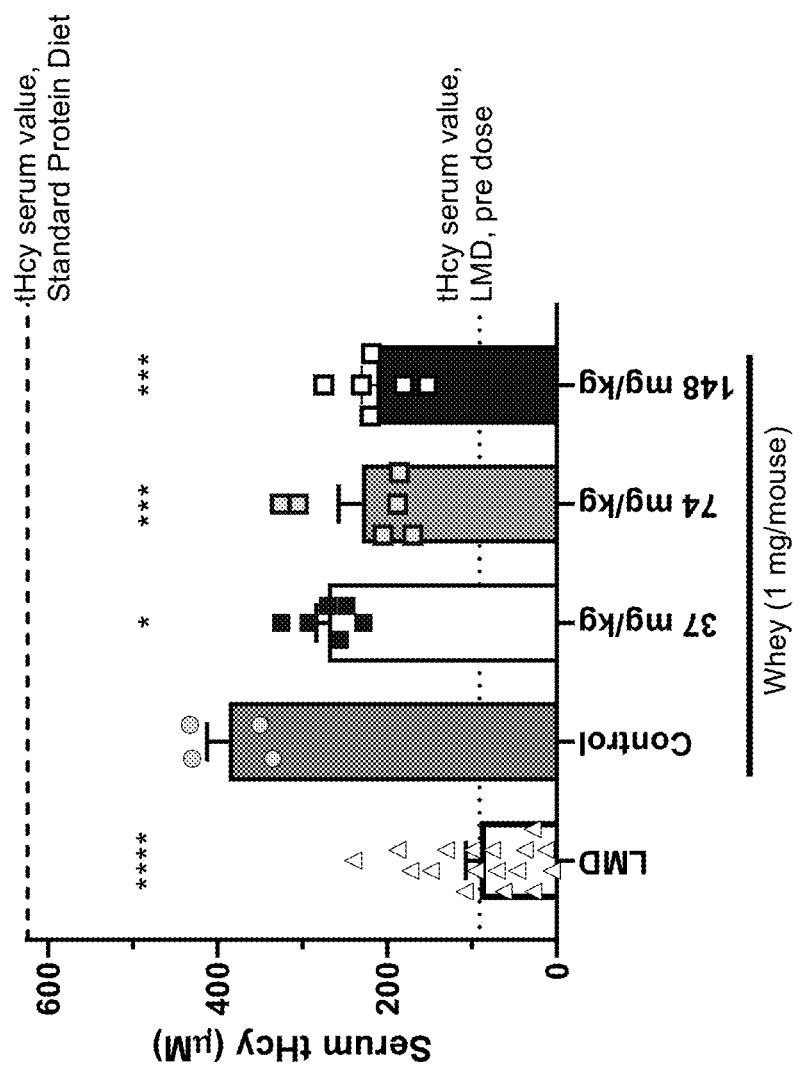
FIGS. 2A and 2B show results of pharmacodynamic (PD) study of engineered methionine gamma lyase of SEQ ID NO: 1706 in Tg-1278T Cbs−/− mouse model.
Figure 2B:
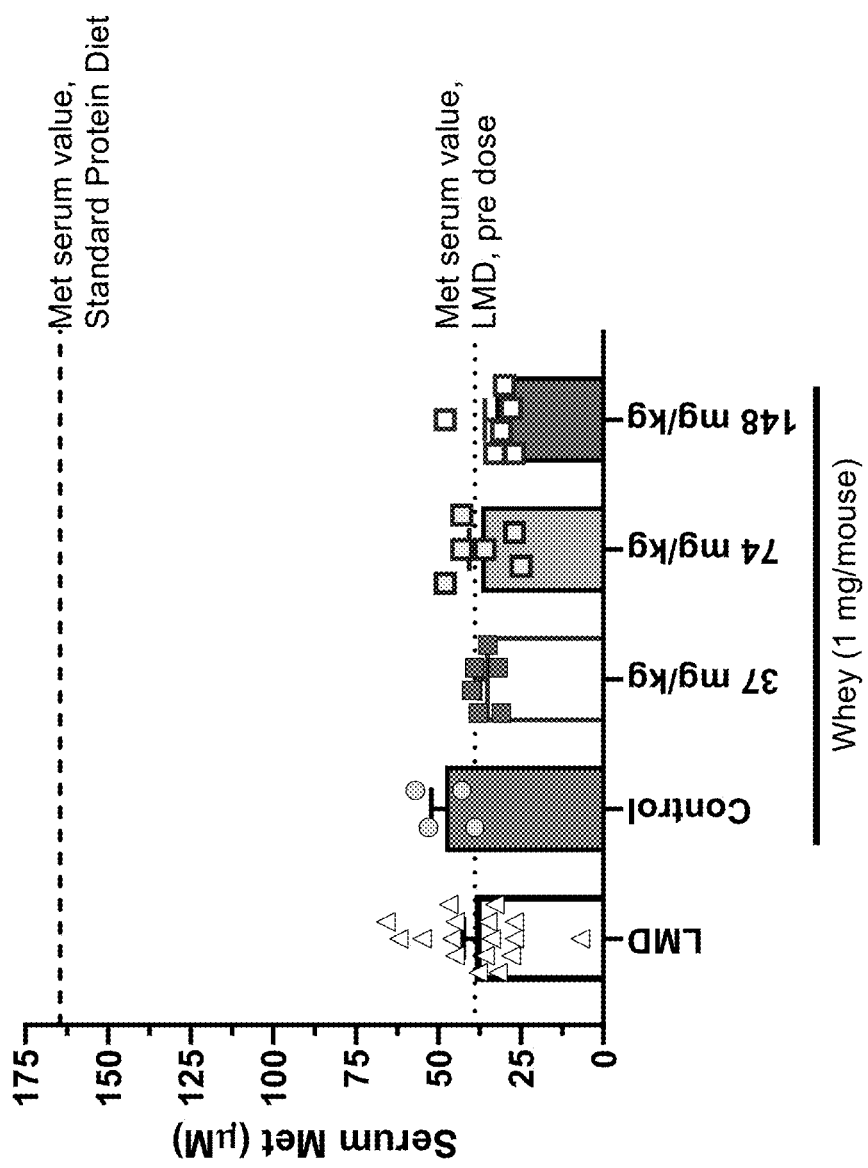

Following administration of the whey protein meal and vehicle, the animals had increases in serum Met and HCy. Treatment with engineered methionine gamma lyase of SEQ ID NO: 1706 immediately following the whey 'meal' suppressed the homocysteine spike at 4 hours in a dose dependent manner [30% ($p<0.05$), 40% ($p<0.001$), and 45% ($p<0.001$), respectively, as assessed by One-way ANOVA compared to vehicle control](FIG. 2A). The results show a non-significant trend toward suppression of methionine by engineered methionine gamma lyase of SEQ ID NO: 1706 at 4 hours (23-32%) (FIG. 2B).

Example 8

In Vivo Lower Dose Response Characterization of Engineered Methionine Gamma Lyase of SEQ ID NO: 1706

Non-naïve male Cynomolgus monkeys (n=10) were utilized for additional in vivo SEQ ID NO: 1706 dose response studies testing lower doses. The study was carried out as a 3 Phase crossover with 1-week washout between dosing occasions. The housing and feeding regimen pre- and post-dose administration, test article administration, and blood sample collection and preparation were the same as described in Example 4. Peptone 'meal' (Casein Digest, Difco™, 2.7% total methionine of which 2.3% was in free form) was given via oral gavage as a suspension with water (12.5 g peptone in a 25 mL volume) immediately prior to test article. The engineered methionine gamma lyase (SEQ ID NO: 1706) was administered at 43 mg/kg (39.3 U/kg; lot #X21034-06) with a bridging dose of 37 mg/kg (39.3 U/kg; lot #F4615) in order to directly compare to the lowest dose administered in the prior study. Additional lower doses [21.5 mg/kg (19.7 U/kg) and 10.7 mg/kg (9.8 U/kg)] of lot #X21034-06 were also assessed. Plasma samples were analyzed for levels of essential amino acids (methionine, phenylalanine, leucine, isoleucine, valine, histidine, tryptophan, lysine, threonine) and tyrosine using LC-MS, against a standard curve for each measure.

Administration of peptone 'meal' by oral gavage resulted in an increase in methionine levels above the fasting level, to a maximum of approximately 53 µM at the 2-hour time point, when dosed with vehicle control (50 mM potassium phosphate). Treatment with the engineered methionine gamma lyase (SEQ ID NO: 1706) immediately following the peptone 'meal' significantly suppressed the methionine spike in all doses tested. The lowest dose (10.7 mg/kg) resulted in a 23% suppression of plasma methionine while all higher doses (21.5 mg/kg and 43 mg/kg of lot #X21034-06, and 37 mg/kg of lot #F4615) exhibited a similar effect of treatment (>70% suppression of plasma methionine, $p<0.05$). As in the prior studies, administration of the methionine gamma lyase (SEQ ID NO: 1706) had no effect on plasma phenylalanine or tyrosine. There was also no effect of treatment in plasma on any of the remaining essential amino acids accessed.

Example 9

In Vivo 3-Day Repeat Dose Characterization of Engineered Methionine Gamma Lyase of SEQ ID NO: 1706

Non-naïve male Cynomolgus monkeys (n=12) were utilized for assessment of plasma amino acid response following three days of consecutive daily doses of SEQ ID NO:1706 following a peptone bolus. The housing and feeding regimen pre- and post-dose administration, test article administration, and blood sample collection and preparation were the same as described in Example 4. Peptone 'meal' (Casein Digest, Difco™, 2.7% total methionine of which 2.3% was in free form) was given via oral gavage as a suspension with water (12.5 g peptone in a 25 mL volume) immediately prior to test article or vehicle (50 mM potassium phosphate). The engineered methionine gamma lyase (SEQ ID NO: 1706) was administered at 10.7 mg/kg (9.8 U/kg; lot #X21034-06); chosen dose level was based upon data obtained from a prior study. Plasma samples were analyzed for levels of essential amino acids (methionine, phenylalanine, leucine, isoleucine, valine, histidine, tryptophan, lysine, threonine) and tyrosine using LC-MS, against a standard curve for each measure.

Administration of peptone 'meal' by oral gavage resulted in an increase in methionine levels above the fasting level on all three dosing days when dosed with vehicle control (50 mM potassium phosphate), though maximum methionine spike after peptone bolus was less pronounced upon repeat challenge (135 µM on Day 1, 113 µM on Day 2, and 88 µM on Day 3, each at 2 hours post gavage). Treatment with the engineered methionine gamma lyase (SEQ ID NO: 1706) immediately following the peptone 'meal' suppressed the methionine spike down to a similar level after daily treatment (~75 µM on Day 1 & 2, and 60 µM on Day 3). Treatment suppressed plasma methionine area under the curve (AUC) 54% on Day 1 (unpaired t-test; $p<0.01$), 45% on Day 2 (unpaired t-test; $p<0.05$), and 22% on Day 3 when compared to vehicle control for each respective day. As in prior studies, administration of the methionine gamma lyase (SEQ ID NO: 1706) had no effect on other plasma essential amino acids or tyrosine.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention.

SEQUENCE LISTING (1734 sequences)

SEQ ID NO: 1 - DNA, 1200 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgcttaatga

SEQ ID NO: 2 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 3 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatacccaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactctttagccgcgctgtctctctgggtgatgcggagagcctggtccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgct

SEQ ID NO: 4 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDTQALKGALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGQEAGRRFMNALQLFSRAVSLGDAESLVQHPASMTHSSYTPQERAHHGISEGLVRLSVGLEDVDDLLADIDQALKACA

SEQ ID NO: 5 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgcg

SEQ ID NO: 6 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAQHGISEGLVRLSVGLEDVDDLLADIDQALKACA

SEQ ID NO: 7 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgcg

SEQ ID NO: 8 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 9 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgct

SEQ ID NO: 10 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 11 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgattgtgagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 12 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDCESLAQHPASMTHSSYTPQERAQHGISEGLVRLSVGLEDVDDLLADIDQALKACA

SEQ ID NO: 13 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactcttttcgcgcgctgtctctctgggtgatacggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgct

SEQ ID NO: 14 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLCDLQALKGALTPKTRMIYFETPANPNMQLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 15 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactcttttcgcgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 16 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 17 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttcaccgcgctgtctctctgggtgattgtgagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 18 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLCDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFHRAVSLGDCESLAQHPASMTHSSYTPQERAHHGISEGLVRLSVGLEDVDDLLADIDQALKACA

SEQ ID NO: 19 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcaattatcctggtctgccgaacttcgcccagtatgctttggctcagcgccaaatgcgcctgccgggtggcatgattgcgtttgagctgaaaggtggcatcgaagcgggtcgtcgcttcatgaacgccctgcaactctttcaccgcgctgtctctctgggtgatacggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgcg

SEQ ID NO: 20 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLPLRMDRHCANAQQVAEHLARQPQVELINYPGLPNFAQYALAQRQMRLPGGMIAFELKGGIEAGRRFMNALQLFHRAVSLGDTESLAQHPASMTHSSYTPQERAQHGISEGLVRLSVGLEDVDDLLADIDQALKACA

SEQ ID NO: 21 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactcttttcgcgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 22 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDAESLAQHPASMTHSSYTPQERAHHGISEGLVRLSVGLEDVDDLLADIDQALKACA

SEQ ID NO: 23 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgaacttcgcccagtatgctttggctcagcgccaaatgcgcctgccgggtggcatgattgcgtttgagctgaaaggtggcgccgaagcgggtcgtcgcttcatgaacgccctgcaactctttcaccgcgctgtctctctgggtgattgtgagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtccg

SEQ ID NO: 24 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLCDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPNFAQYALAQRQMRLPGGMIAFELKGGAEAGRRFMNALQLFHRAVSLGDCESLAQHPASMTHSSYTPQERAHHGISEGLVRLSVGLEDVDDLLADIDQALKACP

SEQ ID NO: 25 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactcttttcgcgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 26 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLCDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLPLRMDRHCANAQQVAEHLARQPQVELINYPGLPSFAQYALAQRQMRLPGGMIAFELKGGQEAGRRFMNALQLFSRAVSLGDAESLAQHPASMTHSSYTPQERAQHGISEGLVRLSVGLEDVDDLLADIDQALKACA

SEQ ID NO: 27 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactcttttcgcgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 28 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGQEAGRRFMNALQLFSRAVSLGDAESLAQHPASMTHSSYTPQERAQHGISEGLVRLSVGLEDVDDLLADIDQALKACA

SEQ ID NO: 29 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtccg

SEQ ID NO: 30 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAQHGISEGLVRLSVGLEDVDDLLADIDQALKACP

SEQ ID NO: 31 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatacccaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgaacttcgcccagtatgctttggctcagcgccaaatgcgcctgccgggtggcatgattgcgtttgagctgaaaggtggccaagaagcgggtcgtcgcttcatgaacgccctgcaactctttcaccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgcg

SEQ ID NO: 32 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDTQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPNFAQYALAQRQMRLPGGMIAFELKGGQEAGRRFMNALQLFHRAVSLGDAESLAQHPASMTHSSYTPQERAHHGISEGLVRLSVGLEDVDDLLADIDQALKACA

SEQ ID NO: 33 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactcttttcgcgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 34 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 35 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttcaccgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 36 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLCDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFHRAVSLGDAESLAQHPASMTHSSYTPQERAQHGISEGLVRLSVGLEDVDDLLADIDQALKACA

SEQ ID NO: 37 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactcttttcgcgcgctgtctctctgggtgatgcggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgcg

SEQ ID NO: 38 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 39 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttcaccgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 40 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLPLRMDRHCANAQQVAEHLARQPQVELINYPGLPSFAQYALAQRQMRLPGGMIAFELKGGIEAGRRFMNALQLFHRAVSLGDAESLAQHPASMTHSSYTPQERAQHGISEGLVRLSVGLEDVDDLLADIDQALKACA

SEQ ID NO: 41 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactcttttcgcgcgctgtctctctgggtgatacggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtccg

SEQ ID NO: 42 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLPLRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACP

SEQ ID NO: 43 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtccg

SEQ ID NO: 44 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDTESLAQHPASMTHSSYTPQERAHHGISEGLVRLSVGLEDVDDLLADIDQALKACP

SEQ ID NO: 45 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactctttagccgcgctgtctctctgggtgattgtgagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 46 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGQEAGRRFMNALQLFSRAVSLGDCESLAQHPASMTHSSYTPQERAHHGISEGLVRLSVGLEDVDDLLADIDQALKACA

SEQ ID NO: 47 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 48 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTYCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFHRAVSLGDTESLAQHPASMTHSSYTPQERAHHGISEGLVRLSVGLEDVDDLLADIDQALKACA

SEQ ID NO: 49 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatacccaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgattgtgagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgcg

SEQ ID NO: 50 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDTQALKGALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDCESLAQHPASMTHSSYTPQERAQHGISEGLVRLSVGLEDVDDLLADIDQALKACA

SEQ ID NO: 51 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatacccaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 52 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDTQALKGALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 53 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcgtctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactctttcaccgcgctgtctctctgggtgatgcggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgct

SEQ ID NO: 54 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLPLRMDRHCANAQQVAEHLARQPQVELINYPGLPSFAQYALAQRQMRLPGGMIAFELKGGQEAGRRFMNALQLFHRAVSLGDAESLAQHPASMTHSSYTPQERAHHGISEGLVRLSVGLEDVDDLLADIDQALKACA

SEQ ID NO: 55 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactctttcaccgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 56 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGQEAGRRFMNALQLFHRAVSLGDAESLAQHPASMTHSSYTPQERAQHGISEGLVRLSVGLEDVDDLLADIDQALKACA

SEQ ID NO: 57 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactcttttcgcgcgctgtctctctgggtgatacggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgcg

SEQ ID NO: 58 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGQEAGRRFMNALQLFSRAVSLGDTESLAQHPASMTHSSYTPQERAHHGISEGLVRLSVGLEDVDDLLADIDQALKACA

SEQ ID NO: 59 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactcttttcgcgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgcg

SEQ ID NO: 60 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLCDLQALKAALTPKTRMIYFETPANPNMQLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAQHGISEGLVRLSVGLEDVDDLLADIDQALKACA

SEQ ID NO: 61 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatacccaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttcaccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 62 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLCDTQALKAALTPKTRMIYFETPANPNMQLVDIAAVADATRGHDLNIVVDNTLCTPYLQRPLTLGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFHRAVSLGDAESLAQHPASMTHSSYTPQERAHHGISEGLVRLSVGLEDVDDLLADIDQALKACA

SEQ ID NO: 63 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaactatcctggtctgccgaacttcgcccagtatgctttggctcagcgccaaatgcgcctgccgggtggcatgattgcgtttgagctgaaaggtggcattgaagcgggtcgtcgcttcatgaacgccctgcaactcttttcgcgcgctgtctctctgggtgatgcggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtccg

SEQ ID NO: 64 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPNFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACP

SEQ ID NO: 65 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactcttttcgcgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 66 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDAESLAQHPASMTHSSYTPQERAQHGISEGLVRLSVGLEDVDDLLADIDQALKACA

SEQ ID NO: 67 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcgtctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttcaccgcgctgtctctctgggtgatgcggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgcg

SEQ ID NO: 68 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFHRAVSLGDAESLAQHPASMTHSSYTPQERAHHGISEGLVRLSVGLEDVDDLLADIDQALKACA

SEQ ID NO: 69 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcgtctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactctttagccgcgctgtctctctgggtgattgtgagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgcg

SEQ ID NO: 70 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGQEAGRRFMNALQLFSRAVSLGDCESLAQHPASMTHSSYTPQERAQHGISEGLVRLSVGLEDVDDLLADIDQALKACA

SEQ ID NO: 71 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaaggcgcactgaccccgaagacccgcatgatctactttgaaaccccggcgaatccgaacatgcgtctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 72 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKGALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDAESLAQHPASMTHSSYTPQERAHHGISEGLVRLSVGLEDVDDLLADIDQALKACA

SEQ ID NO: 73 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgattgtgagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 74 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDCESLAQHPASMTHSSYTPQERAHHGISEGLVRLSVGLEDVDDLLADIDQALKACA

SEQ ID NO: 75 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgtgtgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttaccctgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgattgtgagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 76 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLCDLQALKAALTPKTRMIYFETPANPNMQLVDIAAVADATRGHDLNIVVDNTYCTPYLQRPLTLGADLVVHSATKYLSGHGDITAGLVVGRKALIDRIRLEGLKDMTGAVLSPHDASLLMRGIKTLPLRMDRHCANAQQVAEHLARQPQVELINYPGLPSFAQYALAQRQMRLPGGMIAFELKGGAEAGRRFMNALQLFSRAVSLGDCESLAQHPASMTHSSYTPQERAQHGISEGLVRLSVGLEDVDDLLADIDQALKACA

SEQ ID NO: 77 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggccaagaagcgggtcgtcgcttcatgaacgccctgcaactcttttcgcgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 78 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGQEAGRRFMNALQLFSRAVSLGDAESLAQHPASMTHSSYTPQERAHHGISEGLVRLSVGLEDVDDLLADIDQALKACA

SEQ ID NO: 79 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcgtctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgccactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttcaccgcgctgtctctctgggtgatgcggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgct

SEQ ID NO: 80 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLPLRMDRHCANAQQVAEHLARQPQVELIAYPGLPSFAQYALAQRQMRLPGGMIAFELKGGIEAGRRFMNALQLFHRAVSLGDAESLAQHPASMTHSSYTPQERAHHGISEGLVRLSVGLEDVDDLLADIDQALKACA

SEQ ID NO: 81 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaaggcgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgattgtgagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 82 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKGALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDCESLAQHPASMTHSSYTPQERAHHGISEGLVRLSVGLEDVDDLLADIDQALKACA

SEQ ID NO: 83 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 84 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDAESLAQHPASMTHSSYTPQERAHHGISEGLVRLSVGLEDVDDLLADIDQALKACA

SEQ ID NO: 85 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgattgtgagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtccg

SEQ ID NO: 86 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDCESLAQHPASMTHSSYTPQERAHHGISEGLVRLSVGLEDVDDLLADIDQALKACP

SEQ ID NO: 87 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatacccaagcactgaaagccgcactgaccccgaagacccgcatgatctactttgaaaccccggcgaatccgaacatgcgtctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgccgaagcgggtcgtcgcttcatgaacgccctgcaactctttagccgcgctgtctctctgggtgatgcggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 88 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDTQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDAESLAQHPASMTHSSYTPQERAQHGISEGLVRLSVGLEDVDDLLADIDQALKACA

SEQ ID NO: 89 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggcctggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 90 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAWLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 91 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcgtctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttcaccgcgctgtctctctgggtgatacggagagcctggcccagcatccggcaagcatgacccacagtagctataccccgcaggaacgtgcacaccatggcattagcgaaggactggtccgtctgagcgttggtctggaagacgtggatgatctgctggccgacattgatcaggccctgaaagcatgtgct

SEQ ID NO: 92 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFHRAVSLGDTESLAQHPASMTHSSYTPQERAHHGISEGLVRLSVGLEDVDDLLADIDQALKACA

SEQ ID NO: 93 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 94 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 95 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaaggcgcactgaccccgaagacccgcatgatctactttgaaaccccggcgaatccgaacatgcgtctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgaacttcgcccagtatgctttggctcagcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccgcaggaacgtgcacaacatggcattagcgaaggactggtccgtctgagcgttggtctggaagacgtggatgatctgctggccgacattgatcaggccctgaaagcatgtgct

SEQ ID NO: 96 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKGALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPNFAQYALAQRQMRLPGGMIAFELKGGIEAGRRFMNALQLFHRAVSLGDTESLAQHPASMTHSSYTPQERAQHGISEGLVRLSVGLEDVDDLLADIDQALKACA

SEQ ID NO: 97 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctggaagcactgaaagcggcactgaccccgaagacccgcatgatctactttgaaaccccggcgaatccgaacatgcagctcgttgacattgcggcggtggtagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaagtagccgagcatctggcccgccagccgcaggtcgaaaagatcaactatcctggtctgccgagcttcgcccagtatgctttggctcagcgccaaatggccctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcagaacatggcattagcgaaggactggtccgtctgagcgttggtctggaagacgtggatgatctgctggccgacattgatcaggccctgaaagcatgtgct

SEQ ID NO: 98 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLEALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVEKINYPGLPSFAQYALAQRQMALPGGMIAFELKGGIEAGRRFMNALQLFSRAVSLGDAESLAQHPASMTHSSYTPQERAEHGISEGLVRLSVGLEDVDDLLADIDQALKACA

SEQ ID NO: 99 - DNA, 1194 bp, Artificial Sequence
  PeMGL variant
atgcgtgatagcaacagcaacaccggctttagcacgcgcgccattcaccacggctatgaccccttatcacacgagggtgccctcgttccgccggtgtatcagaccgccacctttgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctggaagcactgaaagcggcactgaccccgaagacccgcatgatctactttgaaaccccggcgaatccgaacatgcagctcgttgacattgcggcggtggtagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacaggctgtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcagaacatggcattagcgaaggactggtccgtctgagcgttggtctggaagacgtggatgatctgctggccgacattgatcaggccctggacgcatgtgct

SEQ ID NO: 100 - protein, 398 aa, Artificial Sequence
  PeMGL variant
MRDSNSNTGFSTRAIHHGYDPLSHEGALVPPVYQTATFAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLEALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQAVAEHLARQPQVELINYPGLPSFAQYALAQRQMRLPGGMIAFELKGGIEAGRRFMNALQLFSRAVSLGDAESLAQHPASMTHSSYTPQERAEHGISEGLVRLSVGLEDVDDLLADIDQALDACA

SEQ ID NO: 101 - DNA, 1194 bp, Artificial Sequence
  PeMGL variant
atgcgtgatagcaacagcaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctggaagcactgaaagcggcactgaccccgaagacccgcatgatctactttgaaaccccggcgaatccgaacatgcagctcgttgacattgcggcggtggcagacgccacccgcggtcatggtctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaagtagccgagcatctggcccgccagccgcaggtcgaaaagatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcagaacatggcattagcgaaggactggtccgtctgagcgttggtctggaagacgtggatgatctgctggccgacattgatcaggccctgaaagcatgtgct

SEQ ID NO: 102 - protein, 398 aa, Artificial Sequence
  PeMGL variant
MRDSNSNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLEALKAALTPKTRMIYFETPANPNMQLVDIAAVADATRGHGLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVEKINYPGLPSFAQYALAQRQMRLPGGMIAFELKGGIEAGRRFMNALQLFSRAVSLGDAESLAQHPASMTHSSYTPEERAEHGISEGLVRLSVGLEDVDDLLADIDQALKACA

SEQ ID NO: 103 - DNA, 1194 bp, Artificial Sequence
  PeMGL variant
atgcgtgatagcaacagcaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaccgatctggaagcactgaaagcggcactgaccccgaagacccgcatgatctactttgaaaccccggcgaatccgaacatgcagctcgttgacattgcggcggtggtagacgccacccgcggtcatgatctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaagtagccgagcatctggcccgccagccgcaggtcgaaaagatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcagaacatggcattagcgaaggactggtccgtctgagcgttggtctggaagacgtggatgatctgctggccgacattgatcaggccctgaaagcatgtgct

SEQ ID NO: 104 - protein, 398 aa, Artificial Sequence
  PeMGL variant
MRDSNSNTGFSTRAIHHGYDPLSHGGALVPPVYQTATFAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLTDLEALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVEKINYPGLPSFAQYALAQRQMRLPGGMIAFELKGGIEAGRRFMNALQLFSRAVSLGDAESLAQHPASMTHSSYTPQERAEHGISEGLVRLSVGLEDVDDLLADIDQALKACA

SEQ ID NO: 105 - DNA, 1194 bp, Artificial Sequence
  PeMGL variant
atgcgtgatagcaacagcaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgagcgatctggaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaaaagatcaactatcctggtctgccgagcttcgcccagtatgctttggctcagcgccaaatggccctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 106 - protein, 398 aa, Artificial Sequence
  PeMGL variant
MRDSNSNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLSDLEALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVEKINYPGLPSFAQYALAQRQMALPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 107 - DNA, 1194 bp, Artificial Sequence
  PeMGL variant
atgcgtgatagcaacagcaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctggaagcactgaaagcggcactgaccccgaagacccgcatgatctactttgaaaccccggcgaatccgaacatgcagctcgttgacattgcggcggtggcagacgccacccgcggtcatggtctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacaggctgtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcacatcatggcattagcgaaggactggtccgtctgagcgttggtctggaagacgtggatgatctgctggccgacattgatcaggccctgaaagcatgtgct

SEQ ID NO: 108 - protein, 398 aa, Artificial Sequence
  PeMGL variant
MRDSNSNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLEALKAALTPKTRMIYFETPANPNMQLVDIAAVADATRGHGLNIVVDNTYCTPYLQRPLELGADLVVHSATKYLSGHGDITAGLVVGRKALIDRIRLEGLKDMTGAVLSPHDASLLMRGIKTLALRMDRHCANAQAVAEHLARQPQVELINYPGLPSFAQYALAQRQMRLPGGMIAFELKGGIEAGRRFMNALQLFSRAVSLGDAESLAQHPASMTHSSYTPEERAHHGISEGLVRLSVGLEDVDDLLADIDQALKACA

SEQ ID NO: 109 - DNA, 1194 bp, Artificial Sequence
  PeMGL variant
atgcgtgatagcaacagcaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaccgatctgcaagcactgaaagcggcactgaccccgaagacccgcatgatctactttgaaaccccggcgaatccgaacatgcagctcgttgacattgcggcggtggcagacgccacccgcggtcatgatctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 110 - protein, 398 aa, Artificial Sequence
  PeMGL variant
MRDSNSNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLTDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 111 - DNA, 1194 bp, Artificial Sequence
  PeMGL variant
atgcgtgatagcaacagcaacaccggctttagcacgcgcgccattcaccacggctatgaccccttatcacacgggggtgccctcgttccgccggtgtatcagaccgccacctatgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaccgatctgcaagcactgaaagcggcactgaccccgaagacccgcatgatctactttgaaaccccggcgaatccgaacatgcagctcgttgacattgcggcggtggtagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaagtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcagaacatggcattagcgaaggactggtccgtctgagcgttggtctggaagacgtggatgatctgctggccgacattgatcaggccctgaaagcatgtgct

SEQ ID NO: 112 - protein, 398 aa, Artificial Sequence
  PeMGL variant
MRDSNSNTGFSTRAIHHGYDPLSHGGALVPPVYQTATYAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLTDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAEHGISEGLVRLSVGLEDVDDLLADIDQALKACA

SEQ ID NO: 113 - DNA, 1194 bp, Artificial Sequence
  PeMGL variant
atgcgtgatagcaacagcaacaccggctttagcacgcgcgccattcaccacggctatgaccccttatcacacgagggtgccctcgttccgccggtgtatcagaccgccacctacgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 114 - protein, 398 aa, Artificial Sequence
  PeMGL variant
MRDSNSNTGFSTRAIHHGYDPLSHEGALVPPVYQTATYAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 115 - DNA, 1194 bp, Artificial Sequence
  PeMGL variant
atgcgtgatagcaacaacaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggtagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 116 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 117 - DNA, 1194 bp, Artificial Sequence
  PeMGL variant
atgcgtgatagcaacaacaacaccggctttagcacgcgcgccattcaccacggctatgaccccttatcacacgagggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacaggctgtagccgagcatctggcccgccagccgcaggtcgaaaagatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 118 - protein, 398 aa, Artificial Sequence
  PeMGL variant
MRDSNNNTGFSTRAIHHGYDPLSHEGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQAVAEHLARQPQVEKINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 119 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcacatcatggcattagcgaaggactggtccgtctgagcgttggtctggaagacgtggatgatctgctggccgacattgatcaggccctgaaagcatgtgct

SEQ ID NO: 120 - protein, 398 aa, Artificial Sequence
  PeMGL variant
MRDSNNNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPEERAHHGISEGLVRLSVGLEDVDDLLADIDQALKACA

SEQ ID NO: 121 - DNA, 1194 bp, Artificial Sequence
  PeMGL variant
atgcgtgatagcaacaacaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctggaagcactgaaagcggcactgaccccgaagacccgcatgatctactttgaaaccccggcgaatccgaacatgcagctcgttgacattgcggcggtggcagacgccacccgcggtcatgatctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatggccctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcagaacatggcattagcgaaggactggtccgtctgagcgttggtctggaagacgtggatgatctgctggccgacattgatcaggccctgaaagcatgtgct

SEQ ID NO: 122 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLEALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMALPGGMIAFELKGGIEAGRRFMNALQLFSRAVSLGDAESLAQHPASMTHSSYTPEERAEHGISEGLVRLSVGLEDVDDLLADIDQALKACA

SEQ ID NO: 123 - DNA, 1194 bp, Artificial Sequence
  PeMGL variant
atgcgtgatagcaacagcaacaccggctttagcacgcgcgccattcaccacggctatgaccccttatcacacgggggtgccctcgttccgccggtgtatcagaccgccacctatgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatggtctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcagaacatggcattagcgaaggactggtccgtctgagcgttggtctggaagacgtggatgatctgctggccgacattgatcaggccctgaaagcatgtgct

SEQ ID NO: 124 - protein, 398 aa, Artificial Sequence
  PeMGL variant
MRDSNSNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHGLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPEERAEHGISEGLVRLSVGLEDVDDLLADIDQALKACA

SEQ ID NO: 125 - DNA, 1194 bp, Artificial Sequence
  PeMGL variant
atgcgtgatagcaacagcaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgatctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccacccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcagaacatggcattagcgaaggactggtccgtctgagcgttggtctggaagacgtggatgatctgctggccgacattgatcaggccctgaaagcatgtgct

SEQ ID NO: 126 - protein, 398 aa, Artificial Sequence
  PeMGL variant
MRDSNSNTGFSTRAIHHGYDPLSHGGALVPPVYQTATYAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELINYPGLPSFAQYALAQRQMRLPGGMIAFELKGGIEAGRRFMNALQLFSRAVSLGDAESLAQHPASMTHSSYTPEERAEHGISEGLVRLSVGLEDVDDLLADIDQALKACA

SEQ ID NO: 127 - DNA, 1194 bp, Artificial Sequence
  PeMGL variant
atgcgtgatagcaacagcaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctggaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaaaagatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcagaacatggcattagcgaaggactggtccgtctgagcgttggtctggaagacgtggatgatctgctggccgacattgatcaggccctgaaagcatgtgct

SEQ ID NO: 128 - protein, 398 aa, Artificial Sequence
  PeMGL variant
MRDSNSNTGFSTRAIHHGYDPLSHGGALVPPVYQTATFAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLEALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVEKINYPGLPSFAQYALAQRQMRLPGGMIAFELKGGIEAGRRFMNALQLFSRAVSLGDAESLAQHPASMTHSSYTPQERAEHGISEGLVRLSVGLEDVDDLLADIDQALKACA

SEQ ID NO: 129 - DNA, 1194 bp, Artificial Sequence
  PeMGL variant
atgcgtgatagcaacagcaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacaggctgtagccgagcatctggcccgccagccgcaggtcgaaaagatcaactatcctggtctgccgagcttcgcccagtatgctttggctcagcgccaaatggccctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 130 - protein, 398 aa, Artificial Sequence
  PeMGL variant
MRDSNSNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQAVAEHLARQPQVEKINYPGLPSFAQYALAQRQMALPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 131 - DNA, 1194 bp, Artificial Sequence
  PeMGL variant
atgcgtgatagcaacaacaacaccggctttagcacgcgcgccattcaccacggctatgaccccttatcacacgggggtgccctcgttccgccggtgtatcagaccgccacctttgcatttccgaccgtggagtatggcgctgcatgctttgcaggcgaagaaccaggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatggtctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcagaacatggcattagcgaaggactggtccgtctgagcgttggtctggaagacgtggatgatctgctggccgacattgatcaggccctgaaagcatgtgct

SEQ ID NO: 132 - protein, 398 aa, Artificial Sequence
  PeMGL variant
MRDSNNNTGFSTRAIHHGYDPLSHGGALVPPVYQTATFAFPTVEYGAACFAGEEPGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHGLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPEERAEHGISEGLVRLSVGLEDVDDLLADIDQALKACA

SEQ ID NO: 133 - DNA, 1194 bp, Artificial Sequence
  PeMGL variant
atgcgtgatagcaacaacaacaccggctttagcacgcgcgccattcaccacggctatgaccccttatcacacgggggtgccctcgttccgccggtgtatcagaccgccacctatgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggtagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcagaacatggcattagcgaaggactggtccgtctgagcgttggtctggaagacgtggatgatctgctggccgacattgatcaggccctgaaagcatgtgct

SEQ ID NO: 134 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAEHGISEGLVRLSVGLEDVDDLLADIDQALKACA

SEQ ID NO: 135 - DNA, 1194 bp, Artificial Sequence
  PeMGL variant
atgcgtgatagcaacaacaacaccggctttagcacgcgcgccattcaccacggctatgaccccttatcacacgagggtgccctcgttccgccggtgtatcagaccgccacctatgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatggtctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaaaagatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccggaggaacgtgcacatcatggcattagcgaaggactggtccgtctgagcgttggtctggaagacgtggatgatctgctggccgacattgatcaggccctgaaagcatgtgct

SEQ ID NO: 136 - protein, 398 aa, Artificial Sequence
  PeMGL variant
MRDSNNNTGFSTRAIHHGYDPLSHEGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHGLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVEKINYPGLPSFAQYALAQRQMRLPGGMIAFELKGGIEAGRRFMNALQLFSRAVSLGDAESLAQHPASMTHSSYTPEERAHHGISEGLVRLSVGLEDVDDLLADIDQALKACA

SEQ ID NO: 137 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatgacgcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 138 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMTRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 139 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgtttctctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 140 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALFLFSRAVSLGDAESLAQHPASMTHSSYTPQERAHHGISEGLVRLSVGLEDVDDLLADIDQALKACA

SEQ ID NO: 141 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccgtgcaggaacgtgcacatcatggcattagcgaaggactggtccgtctgagcgttggtctggaagacgtggatgatctgctggccgacattgatcaggccctgaaagcatgtgct

SEQ ID NO: 142 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTVQERAHHGISEGLVRLSVGLEDVDDLLADIDQALKACA

SEQ ID NO: 143 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattcctgcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 144 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIPAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 145 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagaatgtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 146 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQNVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 147 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgataacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 148 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCDNAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 149 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgggtagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 150 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLGSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 151 - DNA, 1194 bp, Artificial Sequence
  PeMGL variant
atgcgtgatagcaacaacaacaccggctttagcacgcgcgccattcaccacggctatgaccccttatcacacggtggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacggcatggcattagcgaaggactggtccgtctgagcgttggtctggaagacgtggatgatctgctggccgacattgatcaggccctgaaagcatgtgct

SEQ ID NO: 152 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERARHGISEGLVRLSVGLEDVDDLLADIDQALKACA

SEQ ID NO: 153 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacatttgggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 154 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIWAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 155 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgctgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 156 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDAESLAQHPASMTHSSYTPQERAHHGISEGLVRLSVGLEDVDDLLADIDQALKACA

SEQ ID NO: 157 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcatgccctgaaagcatgtgct

SEQ ID NO: 158 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDHALKACA

SEQ ID NO: 159 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagcctgtcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 160 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVACHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 161 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcgaggaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 162 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGEEAGRRFMNALQLFSRAVSLGDAESLAQHPASMTHSSYTPQERAHHGISEGLVRLSVGLEDVDDLLADIDQALKACA

SEQ ID NO: 163 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattcctcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 164 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIPRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 165 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccggggttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgtggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 166 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPGFAQYALAQRQMRLPGGMIAFELKGGIEAGRRFMNALQLFSRAVSLGDVESLAQHPASMTHSSYTPQERAHHGISEGLVRLSVGLEDVDDLLADIDQALKACA

SEQ ID NO: 167 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaacttctgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 168 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQLLKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 169 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtagtgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcataatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 170 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGSDLNIVVDNTYCTPYLQRPLELGADLVVHSATKYLSGHGDITAGLVVGRKALIDRIRLEGLKDMTGAVLSPHNASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 171 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaatcgctgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 172 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQSLKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 173 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgttctgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 174 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVVLINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 175 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcgctccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 176 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRAPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 177 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtgcggacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 178 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGADLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 179 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctaggcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 180 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 181 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtataatttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 182 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYNLAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 183 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcaaggaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 184 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGKEAGRRFMNALQLFSRAVSLGDAESLAQHPASMTHSSYTPQERAHHGISEGLVRLSVGLEDVDDLLADIDQALKACA

SEQ ID NO: 185 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccaccactggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 186 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATTGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 187 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagaccgcgatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 188 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTAMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 189 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaacagggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 190 - protein, 398 aa, Artificial Sequence
  PeMGL variant
MRDSNNNTGFSTRAIHHGYDPLSHGGALVPPVYQTATYAFPTVEYGAACFAGEQGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 191 - DNA, 1194 bp, Artificial Sequence
  PeMGL variant
atgtctgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 192 - protein, 398 aa, Artificial Sequence
  PeMGL variant
MSDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 193 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtatgttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 194 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRMFMNALQLFSRAVSLGDAESLAQHPASMTHSSYTPQERAHHGISEGLVRLSVGLEDVDDLLADIDQALKACA

SEQ ID NO: 195 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaacggggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaatcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 196 - protein, 398 aa, Artificial Sequence
  PeMGL variant
MRDSNNNTGFSTRAIHHGYDPLSHGGALVPPVYQTATYAFPTVEYGAACFAGERGGHFYSRISNPTLALLEQRMASLEGGEAGLALASGMGAITSTLWTLLRPGDELIVGRTLYGCTFAYLHHGIGEFGVKIRHVDLNDLQALKSALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 197 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtcgctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 198 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPSLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 199 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaaattggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 200 - protein, 398 aa, Artificial Sequence
  PeMGL variant
MRDSNNNTGFSTRAIHHGYDPLSHGGALVPPVYQTATYAFPTVEYGAACFAGEIGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 201 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaaagggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 202 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 203 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgcatgcatgtgct

SEQ ID NO: 204 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALHACA

SEQ ID NO: 205 - DNA, 1194 bp, Artificial Sequence
  PeMGL variant
atgactgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccctgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaacgatctgcaagcactgaaagcggcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggccctgcgtatggatcgccattgtgccaacgcacagcaggtagccgagcatctggcccgccagccgcaggtcgaactgatcaactatcctggtctgccgagcttcgcccagtatgctttggctcagcgccaaatgcgcctgccgggtggcatgattgcgtttgagctgaaaggtggcattgaagcgggtcgtcgcttcatgaacgccctgcaactctttagccgcgctgtctctctgggtgatgcggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 206 - protein, 398 aa, Artificial Sequence
  PeMGL variant
MTDSNNNTGFSTRAIHHGYDPLSHGGALVPPVYQTATYAFPTVEYGAACFAGEEGGHFYSRISNPTLALLEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDAESLAQHPASMTHSSYTPQERAHHGISEGLVRLSVGLEDVDDLLADIDQALKACA

SEQ ID NO: 207 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacctggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgacgacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcaattatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 208 - protein, 398 aa, Artificial Sequence
  PeMGL variant
MRDSNNNTGFSTRAIHHGYDPLSHGGALVPPVYQTATFAFPTVEYGAACFAGEEPGHFYSRISNPTLAILEQRMASLEGGEAGLALASGMGAITSTLWTLLRPGDELIVGRTLYGCTFAYLHHGIGEFGVKIRHVDLNDLQALKAALTPTTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDTESLAQHPASMTHSSYTVQERAEHGISEGLVRLSVGLEDVDDLLADIDQALKACA

SEQ ID NO: 209 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 210 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGKEAGRRFMNALQLFSRAVSLGDTESLAQHPASMTHSSYTPQERAEHGISEGLVRLSVGLEDVDDLLADIDQALKACA

SEQ ID NO: 211 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 212 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 213 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacctggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagcctgtcatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 214 - protein, 398 aa, Artificial Sequence
  PeMGL variant
MRDSNNNTGFSTRAIHHGYDPLSHGGALVPPVYQTATFAFPTVEYGAACFAGEEPGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQNVACHLARQPQVELINYPGLPSFAQYALAQRQMRLPGGMIAFELKGGIEAGRRFMNALQLFSRAVSLGDTESLAQHPASMTHSSYTVQERAEHGISEGLVRLSVGLEDVDDLLADIDQALKACA

SEQ ID NO: 215 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaacatggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 216 - protein, 398 aa, Artificial Sequence
  PeMGL variant
MRDSNNNTGFSTRAIHHGYDPLSHGGALVPPVYQTATYAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 217 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacatggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccgtgcaggaacgtgcacatcatggcattagcgaaggactggtccgtctgagcgttggtctggaagacgtggatgatctgctggccgacattgatcaggccctgaaagcatgtgct

SEQ ID NO: 218 - protein, 398 aa, Artificial Sequence
  PeMGL variant
MRDSNNNTGFSTRAIHHGYDPLSHGGALVPPVYQTATFAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTVQERAHHGISEGLVRLSVGLEDVDDLLADIDQALKACA

SEQ ID NO: 219 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcaattatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 220 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDTESLAQHPASMTHSSYTPQERAHHGISEGLVRLSVGLEDVDDLLADIDQALKACA

SEQ ID NO: 221 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcttatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 222 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGAEAGRRFMNALQLFSRAVSLGDTESLAQHPASMTHSSYTPQERAHHGISEGLVRLSVGLEDVDDLLADIDQALKACA

SEQ ID NO: 223 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacctggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 224 - protein, 398 aa, Artificial Sequence
  PeMGL variant
MRDSNNNTGFSTRAIHHGYDPLSHGGALVPPVYQTATFAFPTVEYGAACFAGEEPGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 225 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccgtgcaggaacgtgcacatcatggcattagcgaaggactggtccgtctgagcgttggtctggaagacgtggatgatctgctggccgacattgatcaggccctgaaagcatgtgct

SEQ ID NO: 226 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGAEAGRRFMNALQLFSRAVSLGDTESLAQHPASMTHSSYTVQERAHHGISEGLVRLSVGLEDVDDLLADIDQALKACA

SEQ ID NO: 227 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccacgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 228 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTTKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGKEAGRRFMNALQLFSRAVSLGDTESLAQHPASMTHSSYTPQERAHHGISEGLVRLSVGLEDVDDLLADIDQALKACA

SEQ ID NO: 229 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccgtgcaggaacgtgcacatcatggcattagcgaaggactggtccgtctgagcgttggtctggaagacgtggatgatctgctggccgacattgatcaggccctgaaagcatgtgct

SEQ ID NO: 230 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTVQERAHHGISEGLVRLSVGLEDVDDLLADIDQALKACA

SEQ ID NO: 231 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgacgacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 232 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPTTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGKEAGRRFMNALQLFSRAVSLGDTESLAQHPASMTHSSYTVQERAEHGISEGLVRLSVGLEDVDDLLADIDQALKACA

SEQ ID NO: 233 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagcctgtcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 234 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVACHLARQPQVELIAYPGLPSFAQYALAQRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 235 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 236 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 237 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaagagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagcctgtcatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 238 - protein, 398 aa, Artificial Sequence
  PeMGL variant
MRDSNNNTGFSTRAIHHGYDPLSHGGALVPPVYQTATFAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVACHLARQPQVELIAYPGLPSFAQYALAQRQMRLPGGMIAFELKGGIEAGRRFMNALQLFSRAVSLGDTESLAQHPASMTHSSYTVQERAEHGISEGLVRLSVGLEDVDDLLADIDQALKACA

SEQ ID NO: 239 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaagagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 240 - protein, 398 aa, Artificial Sequence
  PeMGL variant
MRDSNNNTGFSTRAIHHGYDPLSHGGALVPPVYQTATFAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGAEAGRRFMNALQLFSRAVSLGDTESLAQHPASMTHSSYTPQERAHHGISEGLVRLSVGLEDVDDLLADIDQALKACA

SEQ ID NO: 241 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 242 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 243 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 244 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 245 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 246 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 247 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 248 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 249 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 250 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGKEAGRRFMNALQLFSRAVSLGDTESLAQHPASMTHSSYTVQERAEHGISEGLVRLSVGLEDVDDLLADIDQALKACA

SEQ ID NO: 251 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 252 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 253 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 254 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 255 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcttatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 256 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGAEAGRRFMNALQLFSRAVSLGDTESLAQHPASMTHSSYTPQERAHHGISEGLVRLSVGLEDVDDLLADIDQALKACA

SEQ ID NO: 257 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgacgacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 258 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPTTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 259 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacatggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcaattatcctggtctgccgagcttcgcccagtatgctttggctcgtcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 260 - protein, 398 aa, Artificial Sequence
  PeMGL variant
MRDSNNNTGFSTRAIHHGYDPLSHGGALVPPVYQTATFAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGKEAGRRFMNALQLFSRAVSLGDTESLAQHPASMTHSSYTVQERAEHGISEGLVRLSVGLEDVDDLLADIDQALKACA

SEQ ID NO: 261 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 262 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 263 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacctggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcgtcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 264 - protein, 398 aa, Artificial Sequence
  PeMGL variant
MRDSNNNTGFSTRAIHHGYDPLSHGGALVPPVYQTATFAFPTVEYGAACFAGEEPGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGKEAGRRFMNALQLFSRAVSLGDTESLAQHPASMTHSSYTPQERAHHGISEGLVRLSVGLEDVDDLLADIDQALKACA

SEQ ID NO: 265 - DNA, 1194 bp, Artificial Sequence
  PeMGL variant
atgcgtgatagcaacaacaacaccggctttagcacgcgagccattcaccacggctatgaccccttatcacacggcggtgccctcgttccgccggtgtatcagaccgccacctatgcatttccgaccgtggagtatggcgctgcatgctttgcaggcgaagaacatggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 266 - protein, 398 aa, Artificial Sequence
  PeMGL variant
MRDSNNNTGFSTRAIHHGYDPLSHGGALVPPVYQTATYAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 267 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 268 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGKEAGRRFMNALQLFSRAVSLGDTESLAQHPASMTHSSYTPQERAHHGISEGLVRLSVGLEDVDDLLADIDQALKACA

SEQ ID NO: 269 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcagagcatggcattagcgaaggactggtccgtctgagcgttggtctggaagacgtggatgatctgctggccgacattgatcaggccctgaaagcatgtgct

SEQ ID NO: 270 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 271 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggtggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 272 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGKEAGRRFMNALQLFSRAVSLGDTESLAQHPASMTHSSYTPQERAEHGISEGLVRLSVGLEDVDDLLADIDQALKACA

SEQ ID NO: 273 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 274 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 275 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagcctgtcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 276 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVACHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 277 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 278 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGKEAGRRFMNALQLFSRAVSLGDTESLAQHPASMTHSSYTPQERAHHGISEGLVRLSVGLEDVDDLLADIDQALKACA

SEQ ID NO: 279 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaacatggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccgtgcaggaacgtgcagagcatggcattagcgaaggactggtccgtctgagcgttggtctggaagacgtggatgatctgctggccgacattgatcaggccctgaaagcatgtgct

SEQ ID NO: 280 - protein, 398 aa, Artificial Sequence
  PeMGL variant
MRDSNNNTGFSTRAIHHGYDPLSHGGALVPPVYQTATFAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDTESLAQHPASMTHSSYTVQERAEHGISEGLVRLSVGLEDVDDLLADIDQALKACA

SEQ ID NO: 281 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaagagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccgtgcaggaacgtgcacatcatggcattagcgaaggactggtccgtctgagcgttggtctggaagacgtggatgatctgctggccgacattgatcaggccctgaaagcatgtgct

SEQ ID NO: 282 - protein, 398 aa, Artificial Sequence
  PeMGL variant
MRDSNNNTGFSTRAIHHGYDPLSHGGALVPPVYQTATFAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQNVAEHLARQPQVELINYPGLPSFAQYALAQRQMRLPGGMIAFELKGGIEAGRRFMNALQLFSRAVSLGDTESLAQHPASMTHSSYTVQERAHHGISEGLVRLSVGLEDVDDLLADIDQALKACA

SEQ ID NO: 283 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaagagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcttatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 284 - protein, 398 aa, Artificial Sequence
  PeMGL variant
MRDSNNNTGFSTRAIHHGYDPLSHGGALVPPVYQTATFAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 285 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 286 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 287 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaggcggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcaattatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 288 - protein, 398 aa, Artificial Sequence
  PeMGL variant
MRDSNNNTGFSTRAIHHGYDPLSHGGALVPPVYQTATFAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 289 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaagagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 290 - protein, 398 aa, Artificial Sequence
  PeMGL variant
MRDSNNNTGFSTRAIHHGYDPLSHGGALVPPVYQTATFAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 291 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 292 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 293 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaacatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcacatcatggcattagcgaaggactggtccgtctgagcgttggtctggaagacgtggatgatctgctggccgacattgatcaggccctgaaagcatgtgct

SEQ ID NO: 294 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQNVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 295 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaagagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcttatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctggccgacattgatcaggccctgaaagcatgtgct

SEQ ID NO: 296 - protein, 398 aa, Artificial Sequence
  PeMGL variant
MRDSNNNTGFSTRAIHHGYDPLSHGGALVPPVYQTATFAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLADIDQALKACA

SEQ ID NO: 297 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctacgcatttccgaccgtggagtatggcgctgcatgctttgcaggcgaagaaggtggtcatttctactctcgcatttctaatccgacactggccattctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaggtagccgagcatctggcccgccagccgcaggtcgaactgatcgcatatcctggtctgccgagcttcgcccagtatgctttggctcagcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccgcaggaacgtgcacatcatggcattagcgaaggactggtccgtctgagcgttggtctggaagacgtggatgatctgctgcgcgacattgatcaagccctgaaagcatgtgct

SEQ ID NO: 298 - protein, 398 aa, Artificial Sequence
  PeMGL variant
MRDSNNNTGFSTRAIHHGYDPLSHGGALVPPVYQTATYAFPTVEYGAACFAGEEGGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALAQRQMRLPGGMIAFELKGGIEAGRRFMNALQLFSRAVSLGDTESLAQHPASMTHSSYTPQERAHHGISEGLVRLSVGLEDVDDLLRDIDQALKACA

SEQ ID NO: 299 - DNA, 1194 bp, Artificial Sequence
  PeMGL variant
atgcgtgatagcaacaacaacaccggctttagcacgcgcgccattcaccacggctatgaccccttatcacacggcggtgccctcacgccgccggtgtatcagaccgccacctatgcatttccgaccgtggagtatggcggggcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaatggctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtacgtataccccacaggaacgtgcagagcatggcattagcgaaggactggtccgtctgagcgttggtctggaagacgtggatgatctgctggccgacattgatcaggccctgaaagcatgtgct

SEQ ID NO: 300 - protein, 398 aa, Artificial Sequence
  PeMGL variant
MRDSNNNTGFSTRAIHHGYDPLSHGGALTPPVYQTATYAFPTVEYGGACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEWLARHPQVELIAYPGLPSFAQYALARRQMRLPGGMIAFELKGGIEAGRRFMNALQLFSRAVSLGDTESLAQHPASMTHSTYTPQERAEHGISEGLVRLSVGLEDVDDLLADIDQALKACA

SEQ ID NO: 301 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatctgaccgccacctatgcatttccgaccgtggagtatggcgctgcatgctttgcaggcgaagaaaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaaggttcgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaatgctgctgatgcgcggcatcaagactctggcactgcgtatggatcgccattgtgccaacgcacagcaagtagccgaacacctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagttcgtataccccacaggaacgtgcagagcatggcattagcgaaggactggtccgtctgagcgttggtctggaagacgtggatgatctgctggccgacattgatcaggccctgaaagcatgtgct

SEQ ID NO: 302 - protein, 398 aa, Artificial Sequence
  PeMGL variant
MRDSNNNTGFSTRAIHHGYDPLSHGGALVPPVYLTATYAFPTVEYGAACFAGEEKGHFYSRISNPTLDILEQRMASLEGGEAGLALASGMGAITSTLWTLLRPGDELIVGRTLYGCTFAYLHHGIGEFGVKVRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDAMLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 303 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattgtggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagttcgtataccccacaggaacgtgcagagcatggcattagcgaaggactggtccgtctgagcgttggtctggaagacgtggatgatctgctggccgacattgatcaggccctgaaagcatgtgct

SEQ ID NO: 304 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDIVAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 305 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagattcgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtacgtataccccacaggaacgtgcagagcatggcattagcgaaggactggtccgtctgagcgttggtctggaagacgtggatgatctgctggccgacattgatcaggccctgaaagcatgtgct

SEQ ID NO: 306 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSTYTPQERAEHGISEGLVRLSVGLEDVDDLLADIDQALKACA

SEQ ID NO: 307 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtacgtataccccacaggaacgtgcagagcatggcattagcgaaggactggtccgtctgagcgttggtctggaagacgtggatgatctgctggccgacattgatcaggccctgaaagcatgtgct

SEQ ID NO: 308 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSTYTPQERAEHGISEGLVRLSVGLEDVDDLLADIDQALKACA

SEQ ID NO: 309 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatctgaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagttcgtataccccacaggaacgtgcagagcatggcattagcgaaggactggtccgtctgagcgttggtctggaagacgtggatgatctgctggccgacattgatcaggccctgaaagcatgtgct

SEQ ID NO: 310 - protein, 398 aa, Artificial Sequence
  PeMGL variant
MRDSNNNTGFSTRAIHHGYDPLSHGGALVPPVYLTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 311 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacacctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 312 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 313 - DNA, 1194 bp, Artificial Sequence
  PeMGL variant
atgcgtgatagcaacaacaacaccggctttagcacgcgcgccattcaccacggctatgaccccttatcacacggcggtgccctcacgccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattgtggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 314 - protein, 398 aa, Artificial Sequence
  PeMGL variant
MRDSNNNTGFSTRAIHHGYDPLSHGGALTPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDIVAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 315 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatctgaccgccacctatgcatttccgaccgtggagtatggcgcggcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaaggttcgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaatggctggcccgccaaccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtacgtataccccacaggaacgtgcagagcatggcattagcgaaggactggtccgtctgagcgttggtctggaagacgtggatgatctgctggccgacattgatcaggccctgaaagcatgtgct

SEQ ID NO: 316 - protein, 398 aa, Artificial Sequence
  PeMGL variant
MRDSNNNTGFSTRAIHHGYDPLSHGGALVPPVYLTATYAFPTVEYGAACFAGEEKGHFYSRISNPTLAILEQRMASLEGGEAGLALASGMGAITSTLWTLLRPGDELIVGRTLYGCTFAYLHHGIGEFGVKVRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEWLARQPQVELIAYPGLPSFAQYALARRQMRLPGGMIAFELKGGIEAGRRFMNALQLFSRAVSLGDTESLAQHPASMTHSTYTPQERAEHGISEGLVRLSVGLEDVDDLLADIDQALKACA

SEQ ID NO: 317 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcggggcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagattcgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggtaggtctgaaagacatgaccggcgcggttctgtcgccgcatgatgcatcgctgctgatgcgcggcatcaagactctggcactgcgtatggatcgccattgtgccaacgcacagcaagtagccgaatggctggcccgccaaccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagttcgtataccccacaggaacgtgcagagcatggcattagcgaaggactggtccgtctgagcgttggtctggaagacgtggatgatctgctggccgacattgatcaggccctgaaagcatgtgct

SEQ ID NO: 318 - protein, 398 aa, Artificial Sequence
  PeMGL variant
MRDSNNNTGFSTRAIHHGYDPLSHGGALVPPVYQTATYAFPTVEYGGACFAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLVGLKDMTGAVLSPHDASLLMRGIKTLALRMDRHCANAQQVAEWLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 319 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgcggagtatggcgcggcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctggctcctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 320 - protein, 398 aa, Artificial Sequence
  PeMGL variant
MRDSNNNTGFSTRAIHHGYDPLSHGGALVPPVYQTATYAFPTAEYGAACFAGEEKGHFYSRISNPTLAILEQRMASLEGGEAGLALASGMGAITSTLWTLLAPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 321 - DNA, 1194 bp, Artificial Sequence
  PeMGL variant
atgcgtgatagcaacaacaacaccggctttagcacgcgcgccattcaccacggctatgaccccttatcacacggcggtgccctcacgccgccggtgtatctgaccgccacctatgcatttccgaccgtggagtatggcgctgcatgctttgcaggcgaagaaaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagattcgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattgtggcgggcttagttgtaggtcgtaaagcactgattgatcgcattcgcctggaaggtctgaaagacatgaccggcgcggttctgtcgccgcatgatgcaatgctgctgatgcgcggcatcaagactctggcactgcgtatggatcgccattgtgccaacgcacagcaagtagccgaatggctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtacgtataccccacaggaacgtgcagagcatggcattagcgaaggactggtccgtctgagcgttggtctggaagacgtggatgatctgctggccgacattgatcaggccctgaaagcatgtgct

SEQ ID NO: 322 - protein, 398 aa, Artificial Sequence
  PeMGL variant
MRDSNNNTGFSTRAIHHGYDPLSHGGALTPPVYLTATYAFPTVEYGAACFAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDIVAGLVVGRKALIDRIRLEGLKDMTGAVLSPHDAMLLMRGIKTLALRMDRHCANAQQVAEWLARHPQVELIAYPGLPSFAQYALARRQMRLPGGMIAFELKGGIEAGRRFMNALQLFSRAVSLGDTESLAQHPASMTHSTYTPQERAEHGISEGLVRLSVGLEDVDDLLADIDQALKACA

SEQ ID NO: 323 - DNA, 1194 bp, Artificial Sequence
  PeMGL variant
atgcgtgatagcaacaacaacaccggctttagcacgcgcgccattcaccacggctatgaccccttatcacacggcggtgccctcacgccgccggtgtatcagaccgccacctatgcatttccgaccgtggagtatggcggggcatgctttgcaggcgaagaaaagggtcatttctactctcgcatttctaatccgacactggacatcctggaacagcgcatggcaagcctggaaggtggggaggctggactggccctggcctcaggtatgggcgcgattacctcgaccctctggactctgctggctcctggtgacgagctgattgtgggtcgcaccctgtatggatgtacgtttgcgtatctgcatcacggcattggcgagttcggtgtgaaggttcgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattgtggcgggcttagttgtaggtcgtaaagcactgattgatcgcattcgcctggaaggtctgaaagacatgaccggcgcggttctgtcgccgtttgatgcatcgctgctgatgcgcggcatcaagactctggcactgcgtatggatcgccattgtgccaacgcacagcaagtagccgaacacctggcccgccaaccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtacgtataccccacaggaacgtgcagagcatggcattagcgaaggactggtccgtctgagcgttggtctggaagacgtggatgatctgctggccgacattgatcaggccctgaaagcatgtgct

SEQ ID NO: 324 - protein, 398 aa, Artificial Sequence
  PeMGL variant
MRDSNNNTGFSTRAIHHGYDPLSHGGALTPPVYQTATYAFPTVEYGGACFAGEEKGHFYSRISNPTLDILEQRMASLEGGEAGLALASGMGAITSTLWTLLAPGDELIVGRTLYGCTFAYLHHGIGEFGVKVRHVDLNDLQALKAALTPKTRMIYFETPANPNMQLVDIAAVADATRGHDLNIVVDNTYCTPYLQRPLELGADLVVHSATKYLSGHGDIVAGLVVGRKALIDRIRLEGLKDMTGAVLSPFDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSTYTPQERAEHGISEGLVRLSVGLEDVDDLLADIDQALKACA

SEQ ID NO: 325 - DNA, 1194 bp, Artificial Sequence
  PeMGL variant
atgcgtgatagcaacaacaacaccggctttagcacgcgcgccattcaccacggctatgaccccttatcacacggcggtgccctcacgccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 326 - protein, 398 aa, Artificial Sequence
  PeMGL variant
MRDSNNNTGFSTRAIHHGYDPLSHGGALTPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 327 - DNA, 1194 bp, Artificial Sequence
  PeMGL variant
atgcgtgatagcaacaacaacaccggctttagcacgcgcgccattcaccacggctatgaccccttatcacacggcggtgccctcacgccgccggtgtatctgaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaatggctggcccgccaaccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 328 - protein, 398 aa, Artificial Sequence
  PeMGL variant
MRDSNNNTGFSTRAIHHGYDPLSHGGALTPPVYLTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEWLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 329 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatctgaccgccacctatgcatttccgaccgcggagtatggcggggcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacacctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 330 - protein, 398 aa, Artificial Sequence
  PeMGL variant
MRDSNNNTGFSTRAIHHGYDPLSHGGALVPPVYLTATYAFPTAEYGGACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 331 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 332 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 333 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcaactatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 334 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELINYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 335 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcaactatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 336 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 337 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 338 - protein, 398 aa, Artificial Sequence
  PeMGL variant
MRDSNNNTGFSTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 339 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 340 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 341 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 342 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 343 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggctgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 344 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 345 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 346 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 347 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 348 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 349 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggctgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcaactatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 350 - protein, 398 aa, Artificial Sequence
  PeMGL variant
MRDSNNNTGFSTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 351 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 352 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 353 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 354 - protein, 398 aa, Artificial Sequence
  PeMGL variant
MRDSNNNTGFSTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 355 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctacatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 356 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 357 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 358 - protein, 398 aa, Artificial Sequence
  PeMGL variant
MRDSNNNTGFSTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFHRAVSLGDTESLAQHPASMTHSSYTPQERAEHGISEGLVRLSVGLEDVDDLLADIDQALKACA

SEQ ID NO: 359 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 360 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 361 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcaactatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 362 - protein, 398 aa, Artificial Sequence
  PeMGL variant
MRDSNNNTGFSTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 363 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 364 - protein, 398 aa, Artificial Sequence
  PeMGL variant
MRDSNNNTGFSTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 365 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcaactatcctggtctgccgagcttcgcccagtatgctttggctcgtcgccaaatgcgcctgccgggtggcatgattgcgtttgagctgaaaggtggcgcggaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 366 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 367 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 368 - protein, 398 aa, Artificial Sequence
  PeMGL variant
MRDSNNNTGFSTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 369 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 370 - protein, 398 aa, Artificial Sequence
  PeMGL variant
MRDSNNNTGFSTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 371 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcatatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccaaccgcaggtcgaactgatcaactatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 372 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELINYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 373 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggctgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 374 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 375 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggctgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 376 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 377 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttcatcgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 378 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 379 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggttgacgccacccgcggtcatgacctgaacattgttgtagataacacctattgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 380 - protein, 398 aa, Artificial Sequence
  PeMGL variant
MRDSNNNTGFSTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 381 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaagtgtttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 382 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQVFSRAVSLGDTESLAQHPASMTHSSYTPQERAEHGISEGLVRLSVGLEDVDDLLADIDQALKACA

SEQ ID NO: 383 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggggtcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 384 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALGSGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 385 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcatttctgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 386 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGISEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 387 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacgggagctataccccacaggaacgtgcagagcatggcattagcgaaggactggtccgtctgagcgttggtctggaagacgtggatgatctgctggccgacattgatcaggccctgaaagcatgtgct

SEQ ID NO: 388 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHGSYTPQERAEHGISEGLVRLSVGLEDVDDLLADIDQALKACA

SEQ ID NO: 389 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 390 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLRDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 391 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcctggcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 392 - protein, 398 aa, Artificial Sequence
  PeMGL variant
MRDSNNNTGFSTRAIHHGYDPLSHGGALVPPVYQTATYAFPTVEYGAACLAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 393 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgctgtgaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 394 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRCEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 395 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttcggctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 396 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFRLKGGIEAGRRFMNALQLFSRAVSLGDTESLAQHPASMTHSSYTPQERAEHGISEGLVRLSVGLEDVDDLLADIDQALKACA

SEQ ID NO: 397 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgccggacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 398 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLPDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 399 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagaggcgggcattagcgaaggactggtccgtctgagcgttggtctggaagacgtggatgatctgctggccgacattgatcaggccctgaaagcatgtgct

SEQ ID NO: 400 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 401 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcgcgctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 402 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRALYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 403 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 404 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 405 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcgcggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 406 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRAEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 407 - DNA, 1194 bp, Artificial Sequence
  PeMGL variant
atgcgtgatagcaacaacaacaccggcttttgtacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 408 - protein, 398 aa, Artificial Sequence
  PeMGL variant
MRDSNNNTGFCTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 409 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaattggcagagcatggcattagcgaaggactggtccgtctgagcgttggtctggaagacgtggatgatctgctggccgacattgatcaggccctgaaagcatgtgct

SEQ ID NO: 410 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQELAEHGISEGLVRLSVGLEDVDDLLADIDQALKACA

SEQ ID NO: 411 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattcgggagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 412 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIREFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 413 - DNA, 1194 bp, Artificial Sequence
  PeMGL variant
atgcgtgatagcaacaacaacaccggctttgcgacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 414 - protein, 398 aa, Artificial Sequence
  PeMGL variant
MRDSNNNTGFATRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 415 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacgctagctataccccacaggaacgtgcagagcatggcattagcgaaggactggtccgtctgagcgttggtctggaagacgtggatgatctgctggccgacattgatcaggccctgaaagcatgtgct

SEQ ID NO: 416 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHASYTPQERAEHGISEGLVRLSVGLEDVDDLLADIDQALKACA

SEQ ID NO: 417 - DNA, 1194 bp, Artificial Sequence
  PeMGL variant
atgcgtgatagcaacaacaacaccggctttgggacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 418 - protein, 398 aa, Artificial Sequence
  PeMGL variant
MRDSNNNTGFGTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 419 - DNA, 1194 bp, Artificial Sequence
  PeMGL variant
atgcgtgatagcaacaacaacaccggctttcatacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 420 - protein, 398 aa, Artificial Sequence
  PeMGL variant
MRDSNNNTGFHTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 421 - DNA, 1194 bp, Artificial Sequence
  PeMGL variant
atgcgtgatagcaacaacaacaccggctttaggacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 422 - protein, 398 aa, Artificial Sequence
  PeMGL variant
MRDSNNNTGFRTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 423 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatacttactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 424 - protein, 398 aa, Artificial Sequence
  PeMGL variant
MRDSNNNTGFSTRAIHHGYDPLSHGGALVPPVYQTATYAFPTVEYGAACFAGEEKGHTYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 425 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggggatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 426 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLGILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 427 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgaggagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 428 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIEEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 429 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatccagtatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 430 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 431 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctggatgacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 432 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLDDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 433 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcgtggcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 434 - protein, 398 aa, Artificial Sequence
  PeMGL variant
MRDSNNNTGFSTRAIHHGYDPLSHGGALVPPVYQTATYAFPTVEYGAACVAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 435 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcatggcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 436 - protein, 398 aa, Artificial Sequence
  PeMGL variant
MRDSNNNTGFSTRAIHHGYDPLSHGGALVPPVYQTATYAFPTVEYGAACMAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 437 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgtgtatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 438 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIVYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 439 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaatttctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 440 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEFLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 441 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtttgtataccccacaggaacgtgcagagcatggcattagcgaaggactggtccgtctgagcgttggtctggaagacgtggatgatctgctggccgacattgatcaggccctgaaagcatgtgct

SEQ ID NO: 442 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSLYTPQERAEHGISEGLVRLSVGLEDVDDLLADIDQALKACA

SEQ ID NO: 443 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcagctcgttgacattgcggcggtggcagacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgggggacatgaccggcgcggttctgtcgccgcatgatgcaagcctgctgatgcgcggcatcaagactctggcactgcgtatggatcgccattgtgccaacgcacagcaagtagccgaacatctggcccgccagccgcaggtcgaactgatcgcatatcctggtctgccgagcttcgcccagtatgctttggctcgtcgccaaatgcgcctgccgggtggcatgattgcgtttgagctgaaaggtggcatcgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 444 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMQLVDIAAVADATRGHDLNIVVDNTYCTPYLQRPLELGADLVVHSATKYLSGHGDITAGLVVGRKALIDRIRLEGLGDMTGAVLSPHDASLLMRGIKTLALRMDRHCANAQQVAEHLARQPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 445 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgcatggcaggcgaagagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 446 - protein, 398 aa, Artificial Sequence
  PeMGL variant
MRDSNNNTGFMTRAIHHGYDPLSHGGALVPPVYQTATYAFPTVEYGAACMAGEEKGHFYSRISNPTLDILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 447 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgcatggcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaagggggcattgaagcgggtcgtcgcttcatgaacgccctgcaactctttcaccgcgctgtctctttgggtgatacggagagcctggcccagcatccggcaagcatgacccacagtagctataccccacaggaacgtgcagagcatggcattagcgaaggactggtccgtctgagcgttggtctggaagacgtggatgatctgctggccgaccttgaacaggccctgaaagcatgtgct

SEQ ID NO: 448 - protein, 398 aa, Artificial Sequence
  PeMGL variant
MRDSNNNTGFMTRAIHHGYDPLSHGGALVPPVYQTATFAFPTVEYGAACMAGEQKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADLEQALKACA

SEQ ID NO: 449 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgcatggcaggcgaagagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 450 - protein, 398 aa, Artificial Sequence
  PeMGL variant
MRDSNNNTGFATRAIHHGYDPLSHGGALVPPVYQTATYAFPTVEYGAACMAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 451 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 452 - protein, 398 aa, Artificial Sequence
  PeMGL variant
MRDSNNNTGFATRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 453 - DNA, 1194 bp, Artificial Sequence
  PeMGL variant
atgcgtgatagcaacaacaacaccggcttttgcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 454 - protein, 398 aa, Artificial Sequence
  PeMGL variant
MRDSNNNTGFCTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 455 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 456 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 457 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 458 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 459 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 460 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 461 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 462 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 463 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 464 - protein, 398 aa, Artificial Sequence
  PeMGL variant
MRDSNNNTGFATRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 465 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 466 - protein, 398 aa, Artificial Sequence
  PeMGL variant
MRDSNNNTGFATRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 467 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgcgttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgagcgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 468 - protein, 398 aa, Artificial Sequence
  PeMGL variant
MRDSNNNTGFMTRAIHHGYDPLSHGGALVPPVYQTATYAFPTVEYGAACVAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPSDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 469 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 470 - protein, 398 aa, Artificial Sequence
  PeMGL variant
MRDSNNNTGFATRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 471 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 472 - protein, 398 aa, Artificial Sequence
  PeMGL variant
MRDSNNNTGFATRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFHRAVSLGDTESLAQHPASMTHSSYTPQERAEHGISEGLVRLSVGLEDVDDLLADIDQALKACA

SEQ ID NO: 473 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgagcgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 474 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPSDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 475 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcgcagaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 476 - protein, 398 aa, Artificial Sequence
  PeMGL variant
MRDSNNNTGFSTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRAEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 477 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 478 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 479 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgcatggcaggcgaagagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 480 - protein, 398 aa, Artificial Sequence
  PeMGL variant
MRDSNNNTGFMTRAIHHGYDPLSHGGALVPPVYQTATYAFPTVEYGAACMAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 481 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgtttgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 482 - protein, 398 aa, Artificial Sequence
  PeMGL variant
MRDSNNNTGFATRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPFDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 483 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 484 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 485 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttcaccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 486 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGAEAGRRFMNALQLFHRAVSLGDTESLAQHPASMTHSSYTPQERAEAGISEGLVRLSVGLEDVDDLLADIDQALKACA

SEQ ID NO: 487 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgcatggcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 488 - protein, 398 aa, Artificial Sequence
  PeMGL variant
MRDSNNNTGFATRAIHHGYDPLSHGGALVPPVYQTATYAFPTVEYGAACMAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 489 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcatggcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgtttgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 490 - protein, 398 aa, Artificial Sequence
  PeMGL variant
MRDSNNNTGFSTRAIHHGYDPLSHGGALVPPVYQTATYAFPTVEYGAACMAGEQKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPFDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 491 - DNA, 1194 bp, Artificial Sequence
  PeMGL variant
atgcgtgatagcaacaacaacaccggcttttgcacgcgcgccattcaccacggctatgaccccttatcacacggcggtgccctcgttccgccggtgtatcagaccgccacctttgcatttccgaccgtggagtatggcgctgcatgcatggcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 492 - protein, 398 aa, Artificial Sequence
  PeMGL variant
MRDSNNNTGFCTRAIHHGYDPLSHGGALVPPVYQTATFAFPTVEYGAACMAGEQKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 493 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 494 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 495 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 496 - protein, 398 aa, Artificial Sequence
  PeMGL variant
MRDSNNNTGFATRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 497 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgcatggcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 498 - protein, 398 aa, Artificial Sequence
  PeMGL variant
MRDSNNNTGFATRAIHHGYDPLSHGGALVPPVYQTATFAFPTVEYGAACMAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 499 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 500 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 501 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 502 - protein, 398 aa, Artificial Sequence
  PeMGL variant
MRDSNNNTGFATRAIHHGYDPLSHGGALVPPVYQTATFAFPTVEYGAACFAGEQKGHFYSRISNPTLDILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFHRAVSLGDTESLAQHPASMTHSSYTPQERAEAGISEGLVRLSVGLEDVDDLLADIDQALKACA

SEQ ID NO: 503 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 504 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFSRAVSLGDTESLAQHPASMTHSSYTPQERAEAGISEGLVRLSVGLEDVDDLLADIDQALKACA

SEQ ID NO: 505 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcgttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 506 - protein, 398 aa, Artificial Sequence
  PeMGL variant
MRDSNNNTGFSTRAIHHGYDPLSHGGALVPPVYQTATYAFPTVEYGAACVAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 507 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgcatggcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 508 - protein, 398 aa, Artificial Sequence
  PeMGL variant
MRDSNNNTGFATRAIHHGYDPLSHGGALVPPVYQTATYAFPTVEYGAACMAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 509 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgcatggcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 510 - protein, 398 aa, Artificial Sequence
  PeMGL variant
MRDSNNNTGFATRAIHHGYDPLSHGGALVPPVYQTATFAFPTVEYGAACMAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 511 - DNA, 1194 bp, Artificial Sequence
  PeMGL variant
atgcgtgatagcaacaacaacaccggcttttgcacgcgcgccattcaccacggctatgaccccttatcacacggcggtgccctcgttccgccggtgtatcagaccgccacctttgcatttccgaccgtggagtatggcgctgcatgcgttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 512 - protein, 398 aa, Artificial Sequence
  PeMGL variant
MRDSNNNTGFCTRAIHHGYDPLSHGGALVPPVYQTATFAFPTVEYGAACVAGEQKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 513 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 514 - protein, 398 aa, Artificial Sequence
  PeMGL variant
MRDSNNNTGFMTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 515 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 516 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 517 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgtttgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 518 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPFDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 519 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgcatggcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgagcgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 520 - protein, 398 aa, Artificial Sequence
  PeMGL variant
MRDSNNNTGFMTRAIHHGYDPLSHGGALVPPVYQTATFAFPTVEYGAACMAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPSDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 521 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgcatggcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgtttgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 522 - protein, 398 aa, Artificial Sequence
  PeMGL variant
MRDSNNNTGFMTRAIHHGYDPLSHGGALVPPVYQTATFAFPTVEYGAACMAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLRDMTGAVLSPFDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 523 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 524 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 525 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgcatggcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 526 - protein, 398 aa, Artificial Sequence
  PeMGL variant
MRDSNNNTGFMTRAIHHGYDPLSHGGALVPPVYQTATFAFPTVEYGAACMAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 527 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 528 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 529 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 530 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 531 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 532 - protein, 398 aa, Artificial Sequence
  PeMGL variant
MRDSNNNTGFSTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 533 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 534 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 535 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 536 - protein, 398 aa, Artificial Sequence
  PeMGL variant
MRDSNNNTGFSTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 537 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctttgcatttccgaccgtggagtatggcgctgcatgcgttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 538 - protein, 398 aa, Artificial Sequence
  PeMGL variant
MRDSNNNTGFSTRAIHHGYDPLSHGGALVPPVYQTATFAFPTVEYGAACVAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 539 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 540 - protein, 398 aa, Artificial Sequence
  PeMGL variant
MRDSNNNTGFATRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 541 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcatggcaggcgaacagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 542 - protein, 398 aa, Artificial Sequence
  PeMGL variant
MRDSNNNTGFSTRAIHHGYDPLSHGGALVPPVYQTATYAFPTVEYGAACMAGEQKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 543 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctttgcatttccgaccgtggagtatggcgctgcatgcatggcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 544 - protein, 398 aa, Artificial Sequence
  PeMGL variant
MRDSNNNTGFATRAIHHGYDPLSHGGALVPPVYQTATFAFPTVEYGAACMAGEQKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 545 - DNA, 1194 bp, Artificial Sequence
  PeMGL variant
atgcgtgatagcaacaacaacaccggctttagcacgcgcgccattcaccacggctatgaccccttatcacacggcggtgccctcgttccgccggtgtatcagaccgccacctatgcatttccgaccgtggagtatggcgctgcatgcatggcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcgctgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 546 - protein, 398 aa, Artificial Sequence
  PeMGL variant
MRDSNNNTGFSTRAIHHGYDPLSHGGALVPPVYQTATYAFPTVEYGAACMAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGAEAGRRFMNALQLFSRAVSLGDTESLAQHPASMTHSSYTPQERAEHGISEGLVRLSVGLEDVDDLLADIDQALKACA

SEQ ID NO: 547 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 548 - protein, 398 aa, Artificial Sequence
  PeMGL variant
MRDSNNNTGFMTRAIHHGYDPLSHGGALVPPVYQTATFAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 549 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattgccgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 550 - protein, 398 aa, Artificial Sequence
  PeMGL variant
MRDSNNNTGFMTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIAEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 551 - DNA, 1194 bp, Artificial Sequence
  PeMGL variant
atgcgtgatagcaacaacaacaccggctttgcaacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 552 - protein, 398 aa, Artificial Sequence
  PeMGL variant
MRDSNNNTGFATRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 553 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgcatggcaggcgaagagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 554 - protein, 398 aa, Artificial Sequence
  PeMGL variant
MRDSNNNTGFMTRAIHHGYDPLSHGGALVPPVYQTATFAFPTVEYGAACMAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 555 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccccgaaagcatgtgct

SEQ ID NO: 556 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQAPKACA

SEQ ID NO: 557 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggacatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacacctactgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 558 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLDILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTYCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 559 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttcaccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 560 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFHRAVSLGDTESLAQHPASMTHSSYTPQERAEHGISEGLVRLSVGLEDVDDLLADIDQALKACA

SEQ ID NO: 561 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctttgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 562 - protein, 398 aa, Artificial Sequence
  PeMGL variant
MRDSNNNTGFMTRAIHHGYDPLSHGGALVPPVYQTATFAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 563 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcactctattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 564 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHSIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 565 - DNA, 1200 bp, Artificial Sequence
  PeMGL variant
atgcgtgatagcaacaacaactctggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 566 - protein, 398 aa, Artificial Sequence
  PeMGL variant
MRDSNNNSGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 567 - DNA, 1194 bp, Artificial Sequence
  PeMGL variant
atgcgtgatagcaacaacgtgaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 568 - protein, 398 aa, Artificial Sequence
  PeMGL variant
MRDSNNVTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 569 - DNA, 1194 bp, Artificial Sequence
  PeMGL variant
atgcgtgatagcaacaacgagaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 570 - protein, 398 aa, Artificial Sequence
  PeMGL variant
MRDSNNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 571 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggcttcgctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 572 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEASLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 573 - DNA, 1194 bp, Artificial Sequence
  PeMGL variant
atgcgtgatagccataacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 574 - protein, 398 aa, Artificial Sequence
  PeMGL variant
MRDSHNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 575 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgagtctggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 576 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPSLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 577 - DNA, 1194 bp, Artificial Sequence
  PeMGL variant
atgcgtgatagcattaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 578 - protein, 398 aa, Artificial Sequence
  PeMGL variant
MRDSINNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 579 - DNA, 1194 bp, Artificial Sequence
  PeMGL variant
atgcgtgatagcaacaacaacaccggctttatgacgcgcgccattcaccacggctatgacgcgttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 580 - protein, 398 aa, Artificial Sequence
  PeMGL variant
MRDSNNNTGFMTRAIHHGYDALSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 581 - DNA, 1200 bp, Artificial Sequence
  PeMGL variant
atgcgtgatagcaacaacaacaccggctttatgacgcgcgccattcaccacggctatgaccccttatcacacggcggtgccctcgttccgccggtgtatcagtctgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 582 - protein, 398 aa, Artificial Sequence
  PeMGL variant
MRDSNNNTGFMTRAIHHGYDPLSHGGALVPPVYQSATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 583 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacgttattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 584 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHVIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 585 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacaagggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 586 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTRAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 587 - DNA, 1194 bp, Artificial Sequence
  PeMGL variant
atgcgtgatagcaacaacggtaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 588 - protein, 398 aa, Artificial Sequence
  PeMGL variant
MRDSNNGTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 589 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctcggtgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 590 - protein, 398 aa, Artificial Sequence
  PeMGL variant
MRDSNNNTGFMTRAIHHGYDPLSHGGALVPPVYQTATYAFPTVEYGARCFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 591 - DNA, 1194 bp, Artificial Sequence
  PeMGL variant
atgcgtgataggaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 592 - protein, 398 aa, Artificial Sequence
  PeMGL variant
MRDRNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 593 - DNA, 1194 bp, Artificial Sequence
  PeMGL variant
atgcgtgatagcaacaacaacaccggctttatgacgcgcgccattcaccacggctatgaccccttatcacacggcggtgccctcgttccggcggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 594 - protein, 398 aa, Artificial Sequence
  PeMGL variant
MRDSNNNTGFMTRAIHHGYDPLSHGGALVPAVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 595 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacgcgattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 596 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHAIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 597 - DNA, 1194 bp, Artificial Sequence
  PeMGL variant
atgcgtgatagcaacaacaacaccggctttatgacgcgcgccattcaccacggctatgaccccttatcacacggcggtagtctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 598 - protein, 398 aa, Artificial Sequence
  PeMGL variant
MRDSNNNTGFMTRAIHHGYDPLSHGGSLVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 599 - DNA, 1200 bp, Artificial Sequence
  PeMGL variant
atgcgtgatagcaacaacaacaccggctttatgacgcgcgccattcaccacggctatgaccccttatcacacggcggtgccctcgttccgccggtgtatcagggtgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 600 - protein, 398 aa, Artificial Sequence
  PeMGL variant
MRDSNNNTGFMTRAIHHGYDPLSHGGALVPPVYQGATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 601 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacacaggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 602 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTQAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 603 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacagttgccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 604 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTVAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 605 - DNA, 1194 bp, Artificial Sequence
  PeMGL variant
atgcgtgatagcccgaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 606 - protein, 398 aa, Artificial Sequence
  PeMGL variant
MRDSPNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 607 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacagcggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 608 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTAAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 609 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgacgcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 610 - protein, 398 aa, Artificial Sequence
  PeMGL variant
MRDSNNNTGFMTRAIHHGYDPLSHGGALVPPVTQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 611 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctgggcgctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagcagctataccccacaggaacgtgcagagcatgacattagcgaaggactggtccgtctgagcgttggtctggaagacgtggatgatctgctggccgacattgatcaggccctgaaagcatgtgct

SEQ ID NO: 612 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWALLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 613 - DNA, 1194 bp, Artificial Sequence
  PeMGL variant
atgcgtgatagcaacaacaacccgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 614 - protein, 398 aa, Artificial Sequence
  PeMGL variant
MRDSNNNPGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 615 - DNA, 1194 bp, Artificial Sequence
  PeMGL variant
atgcgtgcgagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgcaatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 616 - protein, 398 aa, Artificial Sequence
  PeMGL variant
MRASNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARNPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 617 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccgaattatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 618 - protein, 398 aa, Artificial Sequence
  PeMGL variant
MRDSNNNTGFMTRAIHHGYDPLSHGGALVPPNYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 619 - DNA, 1194 bp, Artificial Sequence
  PeMGL variant
atgcgttcgagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 620 - protein, 398 aa, Artificial Sequence
  PeMGL variant
MRSSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 621 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttacttatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 622 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFTYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 623 - DNA, 1194 bp, Artificial Sequence
  PeMGL variant
atgcgtgatagcaacaacaacaccggctttatgacgcgcgccattcaccacggctatgaccccttatcacacggcggtgccctcgttaatccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 624 - protein, 398 aa, Artificial Sequence
  PeMGL variant
MRDSNNNTGFMTRAIHHGYDPLSHGGALVNPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 625 - DNA, 1194 bp, Artificial Sequence
  PeMGL variant
atgcgtgatagcgggaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactacgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 626 - protein, 398 aa, Artificial Sequence
  PeMGL variant
MRDSGNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 627 - DNA, 1194 bp, Artificial Sequence
  PeMGL variant
atgcgtgatagcaacaacaactatggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 628 - protein, 398 aa, Artificial Sequence
  PeMGL variant
MRDSNNNYGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 629 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgcagctggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 630 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPQLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 631 - DNA, 1194 bp, Artificial Sequence
  PeMGL variant
atgcgtgatagcaacaacctgaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgtcgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 632 - protein, 398 aa, Artificial Sequence
  PeMGL variant
MRDSNNLTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 633 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtggctcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 634 - protein, 398 aa, Artificial Sequence
  PeMGL variant
MRDSNNNTGFMTRAIHHGYDPLSHGGALVPPVAQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 635 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcaccggattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaaccatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 636 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHRIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPATMTHSSYTPQERAEHDISEGLVRLSVGLEDVDDLLADIDQALKACA

SEQ ID NO: 637 - DNA, 1194 bp, Artificial Sequence
  PeMGL variant
atgcgtgatagcaacaactttaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 638 - protein, 398 aa, Artificial Sequence
  PeMGL variant
MRDSNNFTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 639 - DNA, 1194 bp, Artificial Sequence
  PeMGL variant
atgcgtgatagcaacaacaacaggggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 640 - protein, 398 aa, Artificial Sequence
  PeMGL variant
MRDSNNNRGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 641 - DNA, 1200 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatcaggctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 642 - protein, 398 aa, Artificial Sequence
  PeMGL variant
MRDSNNNTGFMTRAIHHGYDPLSHGGALVPPVYQTATYAFPTVEYQAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 643 - DNA, 1194 bp, Artificial Sequence
  PeMGL variant
atgcgtccgagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 644 - protein, 398 aa, Artificial Sequence
  PeMGL variant
MRPSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 645 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcaccatattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 646 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHHIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 647 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctatgtgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 648 - protein, 398 aa, Artificial Sequence
  PeMGL variant
MRDSNNNTGFMTRAIHHGYDPLSHGGALVPPVYQTATYAFPTVEYGAMCFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 649 - DNA, 1194 bp, Artificial Sequence
  PeMGL variant
atgcgtgatagcaagaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 650 - protein, 398 aa, Artificial Sequence
  PeMGL variant
MRDSKNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 651 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggcccggctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 652 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLARLEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 653 - DNA, 1194 bp, Artificial Sequence
  PeMGL variant
atgcgtgatggtaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 654 - protein, 398 aa, Artificial Sequence
  PeMGL variant
MRDGNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 655 - DNA, 1194 bp, Artificial Sequence
  PeMGL variant
atgcgtgatagcaacaacaacaccgcgtttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 656 - protein, 398 aa, Artificial Sequence
  PeMGL variant
MRDSNNNTAFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 657 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactggttgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 658 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALVDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 659 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgtgtggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 660 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLCGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 661 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacattaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 662 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDINIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 663 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagcctctctgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 664 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKASLTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 665 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgtgtggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 666 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMCGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 667 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatggggggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 668 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMGGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 669 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagcatggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgtcgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 670 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEHGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 671 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccgtgcgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 672 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDAVRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 673 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgcggcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 674 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHAASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 675 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggcggacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 676 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 677 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcggggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 678 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGGVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 679 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcacaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgtcgcgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 680 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGHTLYGCTFAYLHHGIGEFGVKIRHVDLNDLQALKAALTPKTRMIYFETPANPNMRLVDIAAVVDATRGHDLNIVVDNTLCTPYLSRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 681 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatggtgtactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 682 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMVYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 683 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggctcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 684 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGSVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 685 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgactcgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 686 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLTRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 687 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgagtggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 688 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMSGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 689 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacgtggttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 690 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNVVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 691 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttatgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 692 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVMSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 693 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagtttgtggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 694 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVCGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 695 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcacggacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 696 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLTDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 697 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactcattagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 698 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLISRAVSLGDTESLAQHPASMTHSSYTPQERAEHDISEGLVRLSVGLEDVDDLLADIDQALKACA

SEQ ID NO: 699 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcctgaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 700 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGLKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 701 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcttagttgtaggtcgtaaagcactgattgatcgcattcgcctggaaggtctgaaagacatgaccggcgcggttctgtcgccgcatgatgcaagcctgctgatgcgcggcatcaagactctgtcgctgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 702 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLSLRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 703 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggggctgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 704 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLGLRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 705 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagactttaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 706 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDFTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 707 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtgctatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 708 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGAMIAFELKGGIEAGRRFMNALQLFSRAVSLGDTESLAQHPASMTHSSYTPQERAEHDISEGLVRLSVGLEDVDDLLADIDQALKACA

SEQ ID NO: 709 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacctggatcaggccctgaaagcatgtgct

SEQ ID NO: 710 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADLDQALKACA

SEQ ID NO: 711 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatattctggccgacattgatcaggccctgaaagcatgtgct

SEQ ID NO: 712 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDILADIDQALKACA

SEQ ID NO: 713 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgcctcggcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 714 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCASAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 715 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatgctgagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 716 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 717 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctggtgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 718 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLVRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 719 - DNA, 1200 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatcgggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 720 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDRESLAQHPASMTHSSYTPQERAEHDISEGLVRLSVGLEDVDDLLADIDQALKACA

SEQ ID NO: 721 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaagggctggtccgtctgagcgttggtctggaagacgtggatgatctgctggccgacattgatcaggccctgaaagcatgtgct

SEQ ID NO: 722 - protein, 398 aa, Artificial Sequence; identical to SEQ ID NO: 478
  PeMGL variant

SEQ ID NO: 723 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgatttcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 724 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMISFELKGGIEAGRRFMNALQLFSRAVSLGDTESLAQHPASMTHSSYTPQERAEHDISEGLVRLSVGLEDVDDLLADIDQALKACA

SEQ ID NO: 725 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgcttgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 726 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMLAFELKGGIEAGRRFMNALQLFSRAVSLGDTESLAQHPASMTHSSYTPQERAEHDISEGLVRLSVGLEDVDDLLADIDQALKACA

SEQ ID NO: 727 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcaacgtttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 728 - protein, 398 aa, Artificial Sequence
  PeMGL variant
MRDSNNNTGFMTRAIHHGYDPLSHGGALVPPVYQTATYAFPTVEYGAATFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 729 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgattcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 730 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDSESLAQHPASMTHSSYTPQERAEHDISEGLVRLSVGLEDVDDLLADIDQALKACA

SEQ ID NO: 731 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcggcgcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 732 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAARRFMNALQLFSRAVSLGDTESLAQHPASMTHSSYTPQERAEHDISEGLVRLSVGLEDVDDLLADIDQALKACA

SEQ ID NO: 733 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgcagctgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 734 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLQLRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 735 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatggtgagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 736 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDGESLAQHPASMTHSSYTPQERAEHDISEGLVRLSVGLEDVDDLLADIDQALKACA

SEQ ID NO: 737 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcagcgtttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 738 - protein, 398 aa, Artificial Sequence
  PeMGL variant
MRDSNNNTGFMTRAIHHGYDPLSHGGALVPPVYQTATYAFPTVEYGAAAFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 739 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctgaagctgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 740 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLKLRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 741 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgcttcgcggcatcaagactctggcactgcgtatggatcgccattgtgccaacgcacagcaagtagccgaacatctggcccgccatccgcaggtcgaactgatcgcatatcctggtctgccgagcttcgtccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 742 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLLRGIKTLALRMDRHCANAQQVAEHLARHPQVELIAYPGLPSFVQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 743 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgctcgtgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 744 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRSCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 745 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccagtacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 746 - protein, 398 aa, Artificial Sequence
  PeMGL variant
MRDSNNNTGFMTRAIHHGYDPLSHGGALVPPVYQTSTYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 747 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtacgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 748 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGTKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 749 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgctgttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 750 - protein, 398 aa, Artificial Sequence
  PeMGL variant
MRDSNNNTGFMTRAIHHGYDPLSHGGALVPPVYQTATYAFPTVEYGAACFAGEEKGHFYSRCSNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 751 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctacactcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 752 - protein, 398 aa, Artificial Sequence
  PeMGL variant
MRDSNNNTGFMTRAIHHGYDPLSHGGALVPPVYQTATYAFPTVEYGAACFAGEEKGHFYTRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 753 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtgtgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 754 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGVKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 755 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacttgacggcgggcttagttgtaggtcgtaaagcactgattgatcgcattcgcctggaaggtctgaaagacatgaccggtgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 756 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 757 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgctgaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 758 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLLTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 759 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgtctgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 760 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMSAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 761 - DNA, 1200 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctggggaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 762 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLGTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 763 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgttacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 764 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 765 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccacgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 766 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTTYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 767 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagggaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 768 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSGTKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 769 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcgcttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 770 - protein, 398 aa, Artificial Sequence
  PeMGL variant
MRDSNNNTGFMTRAIHHGYDPLSHGGALVPPVYQTATYAFPTVEYGAACFAGEEKGHFYSRASNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 771 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacgggtggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 772 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITGGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 773 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtaattcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 774 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVIHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 775 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggttataaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 776 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGYKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 777 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccatgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 778 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTMYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 779 - DNA, 1200 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgccattctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 780 - protein, 398 aa, Artificial Sequence
  PeMGL variant
MRDSNNNTGFMTRAIHHGYDPLSHGGALVPPVYQTATYAFPTVEYGAACFAGEEKGHFYSRHSNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 781 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaagtccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 782 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFESPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 783 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctaccttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 784 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYLETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 785 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggttgtaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 786 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGCKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 787 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccgatgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 788 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPMNPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 789 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcggggtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 790 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRGVSLGDTESLAQHPASMTHSSYTPQERAEHDISEGLVRLSVGLEDVDDLLADIDQALKACA

SEQ ID NO: 791 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgagcgtatttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 792 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALSVFSRAVSLGDTESLAQHPASMTHSSYTPQERAEHDISEGLVRLSVGLEDVDDLLADIDQALKACA

SEQ ID NO: 793 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 794 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 795 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagcacggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 796 - protein, 398 aa, Artificial Sequence
  PeMGL variant
MRDSNNNTGFMTRAIHHGYDPLSHGGALVPPVYQTATYAFPTVEYGAACFAGLQHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 797 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagaatgtagccgaattcctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtatttcaccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 798 - protein, 398 aa, Artificial Sequence
  PeMGL variant
MRDSNNNTGFMTRAIHHGYDPLSHGGALVPPVYQTATYAFPTVEYGAACFAGLQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQNVAEFLARHPQVELIAYPGLPSFAQYALARRQMRLPGGMIAFELKGGIEAGRRFMNALQVFHRAVSLGDTESLAQHPASMTHSSYTPQERAEHDISEGLVRLSVGLEDVDDLLADIDQALKACA

SEQ ID NO: 799 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctggagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 800 - protein, 398 aa, Artificial Sequence
  PeMGL variant
MRDSNNNTGFMTRAIHHGYDPLSHGGALVPPVYQTATYAFPTVEYGAACFAGLEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 801 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgctacgaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 802 - protein, 398 aa, Artificial Sequence
  PeMGL variant
MRDSNNNTGFMTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRYEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 803 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtgccgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 804 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGADLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEFLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 805 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgctacgaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 806 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRYEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 807 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 808 - protein, 398 aa, Artificial Sequence
  PeMGL variant
MRDSNNNTGFMTRAIHHGYDPLSHGGALVPPVYQTATYAFPTVEYGAACFAGLQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 809 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagcacggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgctacgaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtatttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcatgccctgaaagcatgtgct

SEQ ID NO: 810 - protein, 398 aa, Artificial Sequence
  PeMGL variant
MRDSNNNTGFMTRAIHHGYDPLSHGGALVPPVYQTATYAFPTVEYGAACFAGEQHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRYEGLKDMTGAVLSPHDASLLMRGIKTLALRMDRHCANAQQVAEFLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDHALKACA

SEQ ID NO: 811 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 812 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 813 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtatttcaccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 814 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQVFHRAVSLGDTESLAQHPASMTHSSYTPQERAEHDISEGLVRLSVGLEDVDDLLADIDQALKACA

SEQ ID NO: 815 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagcacggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgctacgaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccaatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 816 - protein, 398 aa, Artificial Sequence
  PeMGL variant
MRDSNNNTGFMTRAIHHGYDPLSHGGALVPPVYQTATYAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRYEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 817 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 818 - protein, 398 aa, Artificial Sequence
  PeMGL variant
MRDSNNNTGFMTRAIHHGYDPLSHGGALVPPVYQTATYAFPTVEYGAACFAGLQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 819 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgctacgaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 820 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRYEGLKDMTGAVLSPHDASLLMRGIKTLALRMDRHCANAQQVAEFLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 821 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 822 - protein, 398 aa, Artificial Sequence
  PeMGL variant
MRDSNNNTGFMTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIVYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 823 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 824 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEFLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 825 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcatgccctgaaagcatgtgct

SEQ ID NO: 826 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDHALKACA

SEQ ID NO: 827 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcatgtagccgaacatctggcccgccatccgcaggtcgaactgatcgtatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 828 - protein, 398 aa, Artificial Sequence
  PeMGL variant
MRDSNNNTGFMTRAIHHGYDPLSHGGALVPPVYQTATYAFPTVEYGAACFAGLQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQHVAEHLARHPQVELIVYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 829 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtgccgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 830 - protein, 398 aa, Artificial Sequence
  PeMGL variant
MRDSNNNTGFMTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGADLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 831 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 832 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 833 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 834 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 835 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcaaggaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcacgccctgaaagcatgtgct

SEQ ID NO: 836 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGKEAGRRFMNALQVFSRAVSLGDTESLAQHPASMTHSSYTPQERAEHDISEGLVRLSVGLEDVDDLLADIDHALKACA

SEQ ID NO: 837 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcaaggaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 838 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGKEAGRRFMNALQVFSRAVSLGDTESLAQHPASMTHSSYTPQERAEHDISEGLVRLSVGLEDVDDLLADIDQALKACA

SEQ ID NO: 839 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcacgccctgaaagcatgtgct

SEQ ID NO: 840 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDHALKACA

SEQ ID NO: 841 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagcacggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 842 - protein, 398 aa, Artificial Sequence
  PeMGL variant
MRDSNNNTGFMTRAIHHGYDPLSHGGALVPPVYQTATYAFPTVEYGAACFAGLQHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 843 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagcacggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 844 - protein, 398 aa, Artificial Sequence
  PeMGL variant
MRDSNNNTGFMTRAIHHGYDPLSHGGALVPPVYQTATYAFPTVEYGAACFAGEQHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 845 - DNA, 1194 bp, Artificial Sequence
  PeMGL variant
atgagtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagaggagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 846 - protein, 398 aa, Artificial Sequence
  PeMGL variant
MSDSNNNTGFMTRAIHHGYDPLSHGGALVPPVYQTATYAFPTVEYGAACFAGEEEGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 847 - DNA, 1194 bp, Artificial Sequence
  PeMGL variant
atgagtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgacaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcaaggaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 848 - protein, 398 aa, Artificial Sequence
  PeMGL variant
MSDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCDNAQQVAEHLARHPQVELIQYPGLPSFAQYALARRQMRLPGGMIAFELKGGKEAGRRFMNALQLFSRAVSLGDTESLAQHPASMTHSSYTPQERAEHDISEGLVRLSVGLEDVDDLLADIDQALKACA

SEQ ID NO: 849 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 850 - protein, 398 aa, Artificial Sequence; identical to SEQ ID NO: 794
  PeMGL variant

SEQ ID NO: 851 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctgcgcgacattgatcaggccctgaaagcatgtgct

SEQ ID NO: 852 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLRDIDQALKACA

SEQ ID NO: 853 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattaatcaggccctgaaagcatgtgct

SEQ ID NO: 854 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADINQALKACA

SEQ ID NO: 855 - DNA, 1194 bp, Artificial Sequence; identical to SEQ ID NO: 811
  PeMGL variant

SEQ ID NO: 856 - protein, 398 aa, Artificial Sequence; identical to SEQ ID NO: 812
  PeMGL variant

SEQ ID NO: 857 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcgccccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 858 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRAPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 859 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctgcgtgacattgatcatgccctgaaagcatgtgct

SEQ ID NO: 860 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLRDIDHALKACA

SEQ ID NO: 861 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagcatggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 862 - protein, 398 aa, Artificial Sequence
  PeMGL variant
MRDSNNNTGFMTRAIHHGYDPLSHGGALVPPVYQTATYAFPTVEYGAACFAGEEHGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 863 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaacagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctgcgtgacattgatcaggccctgaaagcatgtgct

SEQ ID NO: 864 - protein, 398 aa, Artificial Sequence
  PeMGL variant
MRDSNNNTGFMTRAIHHGYDPLSHGGALVPPVYQTATYAFPTVEYGAACFAGEQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEHGISEGLVRLSVGLEDVDDLLRDIDQALKACA

SEQ ID NO: 865 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactctttagccgcgctgtctctctgggtgatacggagagcctggcccagcatccggcaagcatgacccacagtagctataccccacaggaacgtgcagaggctggcattagcgaaggactggtccgtctgagcgttggtctggaagacgtggatgatctgctggccgacattgatcaggccctgaaagcatgtgct

SEQ ID NO: 866 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQLFSRAVSLGDTESLAQHPASMTHSSYTPQERAEAGISEGLVRLSVGLEDVDDLLADIDQALKACA

SEQ ID NO: 867 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcaaagaagcgggtcgtcgcttcatgaacgccctgcaactctttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 868 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGKEAGRRFMNALQLFSRAVSLGDTESLAQHPASMTHSSYTPQERAEHGISEGLVRLSVGLEDVDDLLADIDQALKACA

SEQ ID NO: 869 - DNA, 1194 bp, Artificial Sequence; identical to SEQ ID NO: 477
  PeMGL variant

SEQ ID NO: 870 - protein, 398 aa, Artificial Sequence; identical to SEQ ID NO: 478
  PeMGL variant

SEQ ID NO: 871 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctgcgtgacattgatcaggccctgaaagcatgtgct

SEQ ID NO: 872 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIAYPGLPSFAQYALARRQMRLPGGMIAFELKGGIEAGRRFMNALQVFSRAVSLGDTESLAQHPASMTHSSYTPQERAEHDISEGLVRLSVGLEDVDDLLRDIDQALKACA

SEQ ID NO: 873 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcatgccctgaaagcatgtgct

SEQ ID NO: 874 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQVFSRAVSLGDTESLAQHPASMTHSSYTPQERAEHGISEGLVRLSVGLEDVDDLLADIDHALKACA

SEQ ID NO: 875 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctggagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatggcattagcgaaggactggtccgtctgagcgttggtctggaagacgtggatgatctgctggccgacattgatcaggccctgaaagcatgtgct

SEQ ID NO: 876 - protein, 398 aa, Artificial Sequence
  PeMGL variant
MRDSNNNTGFMTRAIHHGYDPLSHGGALVPPVYQTATYAFPTVEYGAACFAGLEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQVFSRAVSLGDTESLAQHPASMTHSSYTPQERAEHGISEGLVRLSVGLEDVDDLLADIDQALKACA

SEQ ID NO: 877 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcctgcagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgcgtgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatcgcatatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 878 - protein, 398 aa, Artificial Sequence
  PeMGL variant
MRDSNNNTGFMTRAIHHGYDPLSHGGALVPPVYQTATYAFPTVEYGAACFAGLQKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLRDMTGAVLSPHDASLLMRGIKTLALRMDRHCANAQQVAEHLARHPQVELIAYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 879 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggctgacattgatcaggccctgaaagcatgtgct

SEQ ID NO: 880 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEFLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 881 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggtgcgattacctcgaccctctggactctgctgcgccctggtgacgagctgattgtgggtcgcaccctgtatggatgtacgtttgcgtatctgcatcacgggattggccagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatccagtatcctggtctgccgagcttcgcccagtatgctttggctcgtcgccaaatgcgcctgccgggtggtatgattgcgtttgagctgaaaggtggcaaggaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 882 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGQFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEFLARHPQVELIQYPGLPSFAQYALARRQMRLPGGMIAFELKGGKEAGRRFMNALQVFSRAVSLGDTESLAQHPASMTHSSYTPQERAEHDISEGLVRLSVGLEDVDDLLADIDQALKACA

SEQ ID NO: 883 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtaatccactcagcgaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 884 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVIHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 885 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggggctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcaaggaagcgggtcgtcgcttcatgaacgccctgcaagtctttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 886 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGKEAGRRFMNALQVFSRAVSLGDTESLAQHPASMTHSSYTPQERAEHGISEGLVRLSVGLEDVDDLLADIDQALKACA

SEQ ID NO: 887 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggtgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaattcctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 888 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEFLARHPQVELIQYPGLPSFAQYALARRQMRLPGGMIAFELKGGIEAGRRFMNALQVFSRAVSLGDTESLAQHPASMTHSSYTPQERAEHGISEGLVRLSVGLEDVDDLLADIDQALKACA

SEQ ID NO: 889 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggtgcgattacctcgaccctctggactctgctgcgccctggtgacgagctgattgtgggtcgcaccctgtatggatgtacgtttgcgtatctgcatcacgggattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcaaggaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 890 - protein, 398 aa, Artificial Sequence; identical to SEQ ID NO: 838
  PeMGL variant

SEQ ID NO: 891 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggtctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 892 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 893 - DNA, 1194 bp, Artificial Sequence
  PeMGL variant
atgcgtgatagcaacaacaacacgggctttatgacgcgcgccattcaccacggctatgacccattatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggtctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgcaccccgtatctgcaacgtccacttgaactgggtgccgacctggtagttcactcagccaccaagtacctgagcggtcatggtgacatcacggcgggcttagttgtaggtcgtaaagcactgattgatcgcattcgcctggaaggtctgaaggacatgaccggcgcggttctgtcgccgcatgatgcaagcctgctgatgcgcggcatcaagactctggcactgcgtatggatcgccattgtgccagtgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 894 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 895 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaggacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 896 - protein, 398 aa, Artificial Sequence; identical to SEQ ID NO: 794
  PeMGL variant

SEQ ID NO: 897 - DNA, 1194 bp, Artificial Sequence
  PeMGL variant
atgcgtgatagcaacaacaacaccggctttatgacgcgcgccattcaccacggctatgacccattatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgcaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 898 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 899 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggtctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcttagttgtaggtcgtaaagcactgattgatcgcattcgcctggaaggtctgaaggacatgaccggcgcggttctgtcgccgcatgatgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 900 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 901 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 902 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 903 - DNA, 1194 bp, Artificial Sequence
  PeMGL variant
atgcgtgatagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgggcaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 904 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLGTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 905 - DNA, 1194 bp, Artificial Sequence
  PeMGL variant
atgcgtgacagcaacaacaactcgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctagtctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgcgacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 906 - protein, 398 aa, Artificial Sequence
  PeMGL variant
MRDSNNNSGFMTRAIHHGYDPLSHGGALVPPVYQTATYAFPTVEYGAACFAGEEKGHFYSRISNPTLAILEQRMASLEGGEASLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHGISEGLVRLSVGLEDVDDLLADIDQALKACA

SEQ ID NO: 907 - DNA, 1194 bp, Artificial Sequence
  PeMGL variant
atgcgtgacagcaacaacaacacgggctttatgacgcgcgccattcaccacggctatgacccattatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatgatattagcgaaggactggtccgtctgagcgttggtctggaagacgtggatgatctgctggccgacattgatcaggccctgaaagcatgtgct

SEQ ID NO: 908 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 909 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttacctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgatttcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 910 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFTYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMISFELKGGIEAGRRFMNALQLFSRAVSLGDTESLAQHPASMTHSSYTPQERAEHGISEGLVRLSVGLEDVDDLLADIDQALKACA

SEQ ID NO: 911 - DNA, 1194 bp, Artificial Sequence
  PeMGL variant
atgcgtgatagcaacaacaactcgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgatattagcgaaggactggtccgtctgagcgttggtctggaagacgtggatgatctgctggccgacattgatcaggccctgaaagcatgtgct

SEQ ID NO: 912 - protein, 398 aa, Artificial Sequence
  PeMGL variant
MRDSNNNSGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 913 - DNA, 1194 bp, Artificial Sequence
  PeMGL variant
atgcgtgacagcaacaacaactcgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaggacatgaccggcgcggttctgtcgccgcatgatgcaagcctgctgatgcgcggcatcaagactctggctctgcgtatggatcgccattgtgccagtgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatgatattagcgaaggactggtccgtctgagcgttggtctggaagacgtggatgatctgctggccgacattgatcaggccctgaaagcatgtgct

SEQ ID NO: 914 - protein, 398 aa, Artificial Sequence
  PeMGL variant
MRDSNNNSGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCASAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 915 - DNA, 1194 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 916 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 917 - DNA, 1194 bp, Artificial Sequence
  PeMGL variant
atgcgtgatagcaacaacaacaccggctttatgacgcgcgccattcaccacggctatgacccattatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctagtctggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 918 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEASLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 919 - DNA, 1194 bp, Artificial Sequence
  PeMGL variant
atgcgtcctagcaacaacaactcgggctttatgacgcgcgccattcaccacggctatgacccattatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggtctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgacgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgatattagcgaaggactggtccgtctgagcgttggtctggaagacgtggatgatctgctggccgacattgatcaggccctgaaagcatgtgct

SEQ ID NO: 920 - protein, 398 aa, Artificial Sequence
  PeMGL variant
MRPSNNNSGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 921 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgatttcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 922 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMISFELKGGIEAGRRFMNALQLFSRAVSLGDTESLAQHPASMTHSSYTPQERAEHDISEGLVRLSVGLEDVDDLLADIDQALKACA

SEQ ID NO: 923 - DNA, 1194 bp, Artificial Sequence
  PeMGL variant
atgcgtgatagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaatgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtgtttagccgcgctgtctctctgggtgatacggagagcctggcccagcatccggcaagcatgacccacagtagctataccccacaggaacgtgcagagcatggtattagcgaaggactggtccgtctgagcgttggtctggaagacgtggatgatctgctggccgacattgatcaggccctgaaagcatgtgct

SEQ ID NO: 924 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHGISEGLVRLSVGLEDVDDLLADIDQALKACA

SEQ ID NO: 925 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggtctggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgcaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccagtgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 926 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLALRMDRHCASAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 927 - DNA, 1194 bp, Artificial Sequence
  PeMGL variant
atgcgtgatagcaacaacaacaccggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcgtatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggcggacgccactcgcggtcatgacctgaacattgttgtagataacaccctgtgtaccccgtatctgcaacgtccacttgaactgggtgccgacctggtagttcactcagccaccaagtacctgagcggtcatggtgacattacggcgggcttagttgtaggtcgtaaagcactgattgatcgcattcgcctggaaggtctgaaagacatgaccggcgcggttctgtcgccgcatgatgcaagcctgctgatgcgcggcatcaagactctggcactgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaagtctttagccgcgctgtctctctgggtgatactgagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 928 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDITAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQVFSRAVSLGDTESLAQHPASMTHSSYTPQERAEHDISEGLVRLSVGLEDVDDLLADIDQALKACA

SEQ ID NO: 929 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcattgttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 930 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGIVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 931 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgttggagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 932 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIALELKGGIEAGRRFMNALQLFSRAVSLGDTESLAQHPASMTHSSYTPQERAEHDISEGLVRLSVGLEDVDDLLADIDQALKACA

SEQ ID NO: 933 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgatttcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 934 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMISFELKGGIEAGRRFMNALQLFSRAVSLGDTESLAQHPASMTHSSYTPQERAEHDISEGLVRLSVGLEDVDDLLADIDQALKACA

SEQ ID NO: 935 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctggttatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 936 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLVMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 937 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctggcgaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 938 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLATPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 939 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtaagaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 940 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGKKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 941 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgaccttacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 942 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 943 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgactgtagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 944 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDCSLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 945 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccatttgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 946 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTICTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 947 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattcggccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 948 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHSANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 949 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 950 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 951 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgctgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 952 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLLRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 953 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaaagtggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 954 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIESGRRFMNALQLFSRAVSLGDTESLAQHPASMTHSSYTPQERAEHDISEGLVRLSVGLEDVDDLLADIDQALKACA

SEQ ID NO: 955 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctcttttggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 956 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSFGDTESLAQHPASMTHSSYTPQERAEHDISEGLVRLSVGLEDVDDLLADIDQALKACA

SEQ ID NO: 957 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaacttgccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 958 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQLAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 959 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgggtgcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 960 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLGALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 961 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 962 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLISRAVSLGDTESLAQHPASMTHSSYTPQERAEHDISEGLVRLSVGLEDVDDLLADIDQALKACA

SEQ ID NO: 963 - DNA, 1200 bp, Artificial Sequence
  PeMGL variant
atgcgtgacagcaaccggaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 964 - protein, 398 aa, Artificial Sequence
  PeMGL variant
MRDSNRNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 965 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtaaggagcatgacattagcgaaggactggtccgtctgagcgttggtctggaagacgtggatgatctgctggccgacattgatcaggccctgaaagcatgtgcttaatga

SEQ ID NO: 966 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERKEHDISEGLVRLSVGLEDVDDLLADIDQALKACA

SEQ ID NO: 967 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcaagcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 968 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFKQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 969 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattacggcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 970 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGITAGRRFMNALQLFSRAVSLGDTESLAQHPASMTHSSYTPQERAEHDISEGLVRLSVGLEDVDDLLADIDQALKACA

SEQ ID NO: 971 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtgagtgatctgctggccgacattgatcaggccctgaaagcatgtgcttaatga

SEQ ID NO: 972 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVSDLLADIDQALKACA

SEQ ID NO: 973 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggccgtgcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 974 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLAVHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 975 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaaactatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 976 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVETIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 977 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattaaggcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 978 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIKAGRRFMNALQLFSRAVSLGDTESLAQHPASMTHSSYTPQERAEHDISEGLVRLSVGLEDVDDLLADIDQALKACA

SEQ ID NO: 979 - DNA, 1200 bp, Artificial Sequence
  PeMGL variant
atgcgtgacagcaacaacaacacgggctttatgacgcgcgccattcaccacggctatgaccccttaaagcacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 980 - protein, 398 aa, Artificial Sequence
  PeMGL variant
MRDSNNNTGFMTRAIHHGYDPLKHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 981 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtataagttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 982 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYKLARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 983 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaagcgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 984 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVEAIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 985 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatagtcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 986 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHSQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 987 - DNA, 1200 bp, Artificial Sequence
  PeMGL variant
atgcgtgacagcaaccttaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 988 - protein, 398 aa, Artificial Sequence
  PeMGL variant
MRDSNLNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 989 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgcgtgccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 990 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALRAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 991 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccactaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 992 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTTKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 993 - DNA, 1200 bp, Artificial Sequence
  PeMGL variant
atgcgtgacagcaactcgaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 994 - protein, 398 aa, Artificial Sequence
  PeMGL variant
MRDSNSNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 995 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccaagggaacgtgcagagcatgacattagcgaaggactggtccgtctgagcgttggtctggaagacgtggatgatctgctggccgacattgatcaggccctgaaagcatgtgcttaatga

SEQ ID NO: 996 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPRERAEHDISEGLVRLSVGLEDVDDLLADIDQALKACA

SEQ ID NO: 997 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgcttttcgggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 998 - protein, 398 aa, Artificial Sequence
  PeMGL variant
MRDSNNNTGFMTRAIHHGYDPLSHGGALVPPVYQTATYAFPTVEYGAACFSGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 999 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggccaatcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1000 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLANHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1001 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttaatggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1002 - protein, 398 aa, Artificial Sequence
  PeMGL variant
MRDSNNNTGFMTRAIHHGYDPLSHGGALVPPVYQTATYAFPTVEYGAACFNGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1003 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaatggatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1004 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVEWIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1005 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtcgggcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1006 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRRALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1007 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcagtcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1008 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFSQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1009 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaagggatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1010 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVEGIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1011 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgggcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1012 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFGQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1013 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgagttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1014 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYELARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1015 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcctgcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1016 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLPALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1017 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1018 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFPQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1019 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgactgcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1020 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLTALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1021 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaaattatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1022 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVEIIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1023 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgctttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1024 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGAFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1025 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaaagtctgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1026 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKSLIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1027 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagtttgtgcttaatga

SEQ ID NO: 1028 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKVCA

SEQ ID NO: 1029 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgagggcatgtgcttaatga

SEQ ID NO: 1030 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALRACA

SEQ ID NO: 1031 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggccgcgcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1032 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLAAHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1033 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaacgtatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1034 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVERIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1035 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttaagggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1036 - protein, 398 aa, Artificial Sequence
  PeMGL variant
MRDSNNNTGFMTRAIHHGYDPLSHGGALVPPVYQTATYAFPTVEYGAACFKGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1037 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaatcgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1038 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVESIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1039 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaaaggtgtgcttaatga

SEQ ID NO: 1040 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKRCA

SEQ ID NO: 1041 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaacatctgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1042 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKHLIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1043 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgatttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1044 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYDLARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1045 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatcagttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1046 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYQLARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1047 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaaatgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1048 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVEMIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1049 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgttttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1050 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGVFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1051 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgggtaatga

SEQ ID NO: 1052 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACG

SEQ ID NO: 1053 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgtctgcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1054 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLSALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1055 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatgctcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1056 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHAQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1057 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtcagtaatga

SEQ ID NO: 1058 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACQ

SEQ ID NO: 1059 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaacagatccagtatcctggtctgccgagcttcgcccagtatgctttggctcgtcgccaaatgcgcctgccgggtggcatgattgcgtttgagcttaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1060 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVEQIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1061 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgagggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1062 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLRALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1063 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacacctggcccgtcatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1064 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFPQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1065 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1066 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1067 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaattcctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1068 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLAAHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1069 - DNA, 1200 bp, Artificial Sequence
  PeMGL variant
atgcgtgacagccacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcgctcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1070 - protein, 398 aa, Artificial Sequence
  PeMGL variant
MRDSHNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRAHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1071 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1072 - protein, 398 aa, Artificial Sequence; identical to SEQ ID NO: 1018
  PeMGL variant

SEQ ID NO: 1073 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggcctgcgtatggatcgccattgtgccagcgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1074 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1075 - DNA, 1200 bp, Artificial Sequence
  PeMGL variant
atgcgtgacagcaacaacaatacgggctttatgacgcgcgccatacaccacggctatgaccccttatcacacggcggtgccctcgttccgccggtgtatcagaccgccacctatgcatttccgaccgtggagtatggcgctgcatgctttgcaggcgaagaaaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1076 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1077 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctggaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaattcctggcccgtcatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1078 - protein, 398 aa, Artificial Sequence
  PeMGL variant
MRDSNNETGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLARHPQVELIQYPGLPSFPQYALARRQMRLPGGMIAFELKGGIEAGRRFMNALQLFSRAVSLGDTESLAQHPASMTHSSYTPQERAEHDISEGLVRLSVGLEDVDDLLADIDQALDACA

SEQ ID NO: 1079 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctggccctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1080 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1081 - DNA, 1200 bp, Artificial Sequence
  PeMGL variant
atgcgtgacagccacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaggcatgtgcttaatga

SEQ ID NO: 1082 - protein, 398 aa, Artificial Sequence
  PeMGL variant
MRDSHNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1083 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgcaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1084 - protein, 398 aa, Artificial Sequence
  PeMGL variant
MRDSNNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1085 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1086 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1087 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgcaaagcactgattgatcaaattcgcctggaaggtctgcgtgacatgaccggcgcggttctgtcgccgcatgacgcaagcctgctgatgcgcggcatcaagactctggccctgcgtatggatcgccattgtgccagcgcacagcaagtagccgaacatctggcccgccatccgcaggtcgaactgatccagtatcctggtctgccgagcttcgcgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1088 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDQIRLEGLRDMTGAVLSPHDASLLMRGIKTLALRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALDACA

SEQ ID NO: 1089 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaacgcaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccagcgcacagcaagtagccgaacacctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1090 - protein, 398 aa, Artificial Sequence
  PeMGL variant
MRDSNNNTGFMTRAIHHGYDPLSHGGALVPPVYQTATYAFPTVEYGAACFAGERKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1091 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctggaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1092 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1093 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctgcaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1094 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1095 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1096 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1097 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1098 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFPQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1099 - DNA, 1200 bp, Artificial Sequence
  PeMGL variant
atgcgtgacagccacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaggcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1100 - protein, 398 aa, Artificial Sequence
  PeMGL variant
MRDSHNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALDACA

SEQ ID NO: 1101 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggcctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1102 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1103 - DNA, 1200 bp, Artificial Sequence
  PeMGL variant
atgcgtgacagccacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1104 - protein, 398 aa, Artificial Sequence
  PeMGL variant
MRDSHNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1105 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgagttcggtgtgaagatccgtcatgttgatctgaatgatctgcaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccagcgcacagcaagtagccgaacatttggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1106 - protein, 398 aa, Artificial Sequence
  PeMGL variant
MRDSNNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1107 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcgctcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1108 - protein, 398 aa, Artificial Sequence
  PeMGL variant
MRDSNNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRAHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1109 - DNA, 1200 bp, Artificial Sequence
  PeMGL variant
atgcgtgacagccacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggcctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1110 - protein, 398 aa, Artificial Sequence
  PeMGL variant
MRDSHNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1111 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1112 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALDACA

SEQ ID NO: 1113 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacacctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1114 - protein, 398 aa, Artificial Sequence; identical to SEQ ID NO: 1032
  PeMGL variant

SEQ ID NO: 1115 - DNA, 1200 bp, Artificial Sequence
  PeMGL variant
atgcgtccgagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctggaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1116 - protein, 398 aa, Artificial Sequence
  PeMGL variant
MRPSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALDACA

SEQ ID NO: 1117 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaattcctggccgcccatccgcaggtcgaactgatccagtatcctggtctgccgagcttcgcgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1118 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLAAHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1119 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1120 - protein, 398 aa, Artificial Sequence
  PeMGL variant
MRDSNNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1121 - DNA, 1200 bp, Artificial Sequence
  PeMGL variant
atgcgtgacagccacaacgagacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1122 - protein, 398 aa, Artificial Sequence
  PeMGL variant
MRDSHNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1123 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaggcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1124 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLAAHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1125 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaggcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggcctgcgtatggatcgccattgtgccagcgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1126 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1127 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1128 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALDACA

SEQ ID NO: 1129 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcaaattcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1130 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1131 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggcctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1132 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1133 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaggcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgcaaagcactgattgatcgcattcgcctggaaggtctgaaagacatgaccggcgcggttctgtcgccgcatgacgcaagcctgctgatgcgcggcatcaagactctgggcctgcgtatggatcgccattgtgccagcgcacagcaagtagccgaacacctggccgcccatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaggcatgtgcttaatga

SEQ ID NO: 1134 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEHLAAHPQVELIQYPGLPSFPQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1135 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccagcgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1136 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALDACA

SEQ ID NO: 1137 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1138 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1139 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagaaaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaattcctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1140 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1141 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaacgcaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1142 - protein, 398 aa, Artificial Sequence
  PeMGL variant
MRDSNNNTGFMTRAIHHGYDPLSHGGALVPPVYQTATYAFPTVEYGAACFAGERKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1143 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaacgcaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcaaattcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgcaaagcactgattgatcgcattcgcctggaaggtctgaaagacatgaccggcgcggttctgtcgccgcatgacgcaagcctgctgatgcgcggcatcaagactctgggcctgcgtatggatcgccattgtgccaacgcacagcaagtagccgaacacctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1144 - protein, 398 aa, Artificial Sequence
  PeMGL variant
MRDSNNNTGFMTRAIHHGYDPLSHGGALVPPVYQTATYAFPTVEYGAACFAGERKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLAAHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1145 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttgaaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1146 - protein, 398 aa, Artificial Sequence
  PeMGL variant
MRDSNNETGFMTRAIHHGYDPLSHGGALVPPVYQTATYAFETVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1147 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgaattcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggcctgcgtatggatcgccattgtgccagcgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggatgcatgtgcttaatga

SEQ ID NO: 1148 - protein, 398 aa, Artificial Sequence
  PeMGL variant
MRDSNNETGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCASAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALDACA

SEQ ID NO: 1149 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctggccctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1150 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLALRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1151 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctggaggcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1152 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1153 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcaaattcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccagcgcacagcaagtagccgaattcctggccgcccatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1154 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGKFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEFLAAHPQVELIQYPGLPSFPQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1155 - DNA, 1200 bp, Artificial Sequence
  PeMGL variant
atgcgtgacagccacaacgagacgggctttatgacgcgcgccattcaccacggctatgaccccttatcacacggcggtgccctcgttccgccggtgtatcagaccgccacctatgcatttccgaccgtggagtatggcgctgcatgctttgcaggcgaacgcaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggcctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1156 - protein, 398 aa, Artificial Sequence
  PeMGL variant
MRDSHNETGFMTRAIHHGYDPLSHGGALVPPVYQTATYAFPTVEYGAACFAGERKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1157 - DNA, 1200 bp, Artificial Sequence
  PeMGL variant
atgcgtgacagccacaacaatacgggctttatgacgcgcgccattcaccacggctatgaccccttatcacacggcggtgccctcgttccgccggtgtatcagaccgccacctatgcatttgaaaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctgcaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccagcgcacagcaagtagccgaattcctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaggcatgtgcttaatga

SEQ ID NO: 1158 - protein, 398 aa, Artificial Sequence
  PeMGL variant
MRDSHNNTGFMTRAIHHGYDPLSHGGALVPPVYQTATYAFETVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCASAQQVAEFLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1159 - DNA, 1200 bp, Artificial Sequence
  PeMGL variant
atgcgtgacagcaacaacgagacgggctttatgacgcgcgccattcaccacggctatgaccccttatcacacggcggtgccctcgttccgccggtgtatcagaccgccacctatgcatttccaaccgtggagtatggcgctgcatgctttgcaggcgaacgcaagggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcaaattcggtgtgaagatccgtcatgttgatctgaatgatctgcaggcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgcgcagcactgattgatcgcattcgcctggaaggtctgcgtgacatgaccggcgcggttctgtcgccgcatgacgcaagcctgctgatgcgcggcatcaagactctgggcctgcgtatggatcgccattgtgccaacgcacagcaagtagccgaacacctggcccgtcatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaggcatgtgcttaatga

SEQ ID NO: 1160 - protein, 398 aa, Artificial Sequence
  PeMGL variant
MRDSNNETGFMTRAIHHGYDPLSHGGALVPPVYQTATYAFPTVEYGAACFAGERKGHFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRAALIDRIRLEGLRDMTGAVLSPHDASLLMRGIKTLGLRMDRHCANAQQVAEHLARHPQVELIQYPGLPSFPQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1161 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacacctggcccgtcatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1162 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFPQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1163 - DNA, 1200 bp, Artificial Sequence
  PeMGL variant
atgcgtgacagccacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccccgaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgtgacatgaccggcgcggttctgtcgccgcatgacgcaagcctgctgatgcgcggcatcaagactctgggtctgcgtatggatcgccattgtgccagcgcacagcaagtagccgaacacctggcccgtcatccgcaggtcgaactgatccagtatcctggtctgccgagcttcccgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1164 - protein, 398 aa, Artificial Sequence
  PeMGL variant
MRDSHNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCASAQQVAEHLARHPQVELIQYPGLPSFPQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1165 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctgcaagcactgaaagccgcactgaccgataagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1166 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTDKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1167 - DNA, 1200 bp, Artificial Sequence
  PeMGL variant
atgcgtccgagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgaattcggtgtgaagatccgtcatgttgatctgaatgatctgcaggcactgaaagccgcactgaccccgaagacccgcatgatctactttgaaaccccggcgaatccgaacatgcgcctcgttgacattgcggcggtggctgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatacggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1168 - protein, 398 aa, Artificial Sequence
  PeMGL variant
MRPSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVADATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDTESLAQHPASMTHSSYTPQERAEHDISEGLVRLSVGLEDVDDLLADIDQALKACA

SEQ ID NO: 1169 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccgaccgtggagtatggcgctgcatgctttgcaggcgaagagaagggtcatttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcatcacggcattggcgagttcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctggccctgcgtatggatcgccattgtgccagcgcacagcaagtagccgaacatctggcccgccatccgcaggtcgaactgatccagtatcctggtctgccgagcttcgcgcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1170 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCASAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1171 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1172 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1173 - DNA, 1200 bp, Artificial Sequence
  PeMGL variant
atgcgtgacagcaacaacaacacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcaaattcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1174 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGKFGVKIRHVDLNDLQALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1175 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgccgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1176 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1177 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcaagcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1178 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFKQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1179 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtaaacgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcccagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1180 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKRDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1181 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcccagtatgctttggctcgtcgccaaatgcgcctgccgggtggcatgattgcgttcgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1182 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1183 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgcgacatgaccggcgcggttctgtcgccgcatgacgcaagcctggtgatgcgcggcatcaagactctgggtctgcgtatggatcgccattgtgccaacgcacagcaagttgccgaattcctggcccgccatccgcaggtcgaactgatccagtatcctggtctgccgagcttcgcacagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1184 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLVMRGIKTLGLRMDRHCANAQQVAEFLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1185 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgtttgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1186 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1187 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcacagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1188 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1189 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagttgccgaattcctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1190 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1191 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1192 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1193 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1194 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1195 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1196 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQVAEHLARHPQVELIQYPGLPSFKQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1197 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgcgacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcccagtatgctttggctcgtcgccaaatgcgcctgccgggtggcatgattgcgttcgagctgaaaggtggcattgaatcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1198 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLVMRGIKTLGLRMDRHCANAQQIAEHLARHPQVELIQYPGLPSFAQYALARRQMRLPGGMIAFELKGGIESGRRFMNALQLISRAVSLGDAESLAQHPASMTHSSYTPQERAEHDISEGLVRLSVGLEDVDDLLADIDQALKACA

SEQ ID NO: 1199 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagttgccgaacacctggcccgccatccgcaggtcgaactgatccagtatcctggtctgccgagcttcccacagtatgctttggctcgtcgccaaatgcgcctgccgggtggcatgattgcgtttgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1200 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFPQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1201 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaattcctggcccgccatccgcaggtcgaactgatccagtatcctggtctgccgagcttcgcccagtatgctttggctcgtcgccaaatgcgcctgccgggtggcatgattgcgttcgagctgaaaggtggcattgaatcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1202 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEFLARHPQVELIQYPGLPSFAQYALARRQMRLPGGMIAFELKGGIESGRRFMNALQLISRAVSFGDAESLAQHPASMTHSSYTPQERAEHDISEGLVRLSVGLEDVDDLLADIDQALKACA

SEQ ID NO: 1203 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcacagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1204 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1205 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1206 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQIAEHLARHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1207 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaagtagccgaacatctggcccgccatccgcaggtcgaactgatccagtatcctggtctgccgagcttcaagcagtatgctttggctcgtcgccaaatgcgcctgccgggtggcatgattgcgtttgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1208 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLVMRGIKTLGLRMDRHCANAQQVAEHLARHPQVELIQYPGLPSFKQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1209 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagttgccgaattcctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1210 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQVAEFLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1211 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtaaaaaggacatgaccggcgcggttctgtcgccgcatgacgcaagcctgctgatgcgcggcatcaagactctgggtctgcgtatggatcgccattgtgccaacgcacagcaagttgccgaattcctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1212 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKKDMTGAVLSPHDASLLMRGIKTLGLRMDRHCANAQQVAEFLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1213 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaatcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1214 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIESGRRFMNALQLFSRAVSLGDAESLAQHPASMTHSSYTPQERAEHDISEGLVRLSVGLEDVDDLLADIDQALKACA

SEQ ID NO: 1215 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtaaaaaggacatgaccggcgcggttctgtcgccgcatgacgcaagcctggtgatgcgcggcatcaagactctgggtctgcgtatggatcgccattgtgccaacgcacagcaaattgccgaattcctggcccgccatccgcaggtcgaactgatccagtatcctggtctgccgagcttcgcacagtatgctttggctcgtcgccaaatgcgcctgccgggtggcatgattgcgtttgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1216 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKKDMTGAVLSPHDASLVMRGIKTLGLRMDRHCANAQQIAEFLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1217 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaatcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1218 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIESGRRFMNALQLISRAVSLGDAESLAQHPASMTHSSYTPQERAEHDISEGLVRLSVGLEDVDDLLADIDQALKACA

SEQ ID NO: 1219 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtaaacgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcccagtatgctttggctcgtcgccaaatgcgcctgccgggtggcatgattgcgctggagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1220 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKRDMTGAVLSPHDASLLMRGIKTLGLRMDRHCANAQQIAEHLARHPQVELIQYPGLPSFAQYALARRQMRLPGGMIALELKGGIEAGRRFMNALQLFSRAVSLGDAESLAQHPASMTHSSYTPQERAEHDISEGLVRLSVGLEDVDDLLADIDQALKACA

SEQ ID NO: 1221 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1222 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1223 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgtttgagctgaaaggtggcattgaatcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1224 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIESGRRFMNALQLISRAVSLGDAESLAQHPASMTHSSYTPQERAEHDISEGLVRLSVGLEDVDDLLADIDQALKACA

SEQ ID NO: 1225 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtaaaaaggacatgaccggcgcggttctgtcgccgcatgacgcaagcctgctgatgcgcggcatcaagactctgggtctgcgtatggatcgccattgtgccaacgcacagcaagttgccgaacacctggcccgccatccgcaggtcgaactgatccagtatcctggtctgccgagcttcgcccagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1226 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGKKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1227 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1228 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1229 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1230 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLVMRGIKTLGLRMDRHCANAQQIAEHLARHPQVELIQYPGLPSFKQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1231 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1232 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1233 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaatcgggtcgtcgcttcatgaacgccctgcaactgattagccgcgccgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1234 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIESGRRFMNALQLISRAVSLGDAESLAQHPASMTHSSYTPQERAEHDISEGLVRLSVGLEDVDDLLADIDQALKACA

SEQ ID NO: 1235 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtaaacgcgacatgaccggcgcggttctgtcgccgcatgacgcaagcctggtgatgcgcggcatcaagactctgggtctgcgtatggatcgccattgtgccaacgcacagcaaattgccgaacatctggcccgccatccgcaggtcgaactgatccagtatcctggtctgccgagcttcccacagtatgctttggctcgtcgccaaatgcgcctgccgggtggcatgattgcgctggagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1236 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKRDMTGAVLSPHDASLVMRGIKTLGLRMDRHCANAQQIAEHLARHPQVELIQYPGLPSFPQYALARRQMRLPGGMIALELKGGIEAGRRFMNALQLISRAVSLGDAESLAQHPASMTHSSYTPQERAEHDISEGLVRLSVGLEDVDDLLADIDQALKACA

SEQ ID NO: 1237 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1238 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQIAEHLARHPQVELIQYPGLPSFKQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1239 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaagttgccgaattcctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1240 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQVAEFLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1241 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagttgccgaattcctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1242 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLARHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1243 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgtttgagctgaaaggtggcattgaatcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1244 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQIAEHLARHPQVELIQYPGLPSFKQYALARRQMRLPGGMIAFELKGGIESGRRFMNALQLFSRAVSLGDAESLAQHPASMTHSSYTPQERAEHDISEGLVRLSVGLEDVDDLLADIDQALKACA

SEQ ID NO: 1245 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaattcctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1246 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQIAEFLARHPQVELIQYPGLPSFKQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1247 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaattcctggcccgccatccgcaggtcgaactgatccagtatcctggtctgccgagcttcccacagtatgctttggctcgtcgccaaatgcgcctgccgggtggcatgattgcgctggagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1248 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEFLARHPQVELIQYPGLPSFPQYALARRQMRLPGGMIALELKGGIEAGRRFMNALQLFSRAVSLGDAESLAQHPASMTHSSYTPQERAEHDISEGLVRLSVGLEDVDDLLADIDQALKACA

SEQ ID NO: 1249 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtaaaaaggacatgaccggcgcggttctgtcgccgcatgacgcaagcctgctgatgcgcggcatcaagactctgggtctgcgtatggatcgccattgtgccaacgcacagcaagttgccgaattcctggcccgccatccgcaggtcgaactgatccagtatcctggtctgccgagcttcaagcagtatgctttggctcgtcgccaaatgcgcctgccgggtggcatgattgcgtttgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1250 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKKDMTGAVLSPHDASLLMRGIKTLGLRMDRHCANAQQVAEFLARHPQVELIQYPGLPSFKQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1251 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcttagttgtaggtcgtaaagcactgattgatcgcattcgcctggaaggtaaacgcgacatgaccggcgcggttctgtcgccgcatgacgcaagcctggtgatgcgcggcatcaagactctgggtctgcgtatggatcgccattgtgccaacgcacagcaaattgccgaattcctggcccgccatccgcaggtcgaactgatccagtatcctggtctgccgagcttcccacagtatgctttggctcgtcgccaaatgcgcctgccgggtggcatgattgcgttcgagctgaaaggtggcattgaatcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1252 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGKRDMTGAVLSPHDASLVMRGIKTLGLRMDRHCANAQQIAEFLARHPQVELIQYPGLPSFPQYALARRQMRLPGGMIAFELKGGIESGRRFMNALQLFSRAVSLGDAESLAQHPASMTHSSYTPQERAEHDISEGLVRLSVGLEDVDDLLADIDQALKACA

SEQ ID NO: 1253 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaattcctggcccgccatccgcaggtcgaactgatccagtatcctggtctgccgagcttcgcacagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1254 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLRDMTGAVLSPHDASLLMRGIKTLGLRMDRHCANAQQIAEFLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1255 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcctggttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagttgccgaattcctggccgcccatccgcaggtcgaactgatccagtatcctggtctgccgagcttcgcgcagtatgcattggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagtctgtgcttaatga

SEQ ID NO: 1256 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEFLAAHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKVCA

SEQ ID NO: 1257 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaagtagccgaacatctggcccgccatccgcaggtcgaactgatccagtatcctggtctgccgagcttcccgcagtatcaattggctcgtcgccaaatgcgcctgccgggtggcatgattgcgttcgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1258 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQVAEHLARHPQVELIQYPGLPSFPQYQLARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1259 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcatcgttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1260 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1261 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgcgccaacgcacagcaaattgccgaattcctggcccgtcatccgcaggtcgaactgatccagtatcctggtctgccgagcttcaaacagtatcaattggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1262 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEFLARHPQVELIQYPGLPSFKQYQLARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1263 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcatcgttgtaggtcgtaaatcgctgattgatcgcattcgcctggaaggtctgaaggacatgaccggcgcggttctgtcgccgcatgacgcaagcctgctgatgcgcggcatcaagactctgggtctgcgtatggatcgccattgcgccaacgcacagcaagttgccgaattcctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcctgtgcttaatga

SEQ ID NO: 1264 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGIVVGRKSLIDRIRLEGLKDMTGAVLSPHDASLLMRGIKTLGLRMDRHCANAQQVAEFLARHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1265 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcatcgttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1266 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGIVVGRKALIDRIRLEGLKDMTGAVLSPHDASLVMRGIKTLGLRMDRHCANAQQVAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1267 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaattcctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1268 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEFLAAHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1269 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaatcgctgattgatcgcattcgcctggaaggtctgaaagacatgaccggcgcggttctgtcgccgcatgacgcaagcctggtgatgcgcggcatcaagactctgggtctgcgtatggatcgccattgtgccaacgcacagcaaattgccgaacacctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1270 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKSLIDRIRLEGLKDMTGAVLSPHDASLVMRGIKTLGLRMDRHCANAQQIAEHLAAHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1271 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcatcgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgcgccaacgcacagcaagtagccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtaaggagcatgacattagcgaaggactggtccgtctgagcgttggtctggaagacgtggatgatctgctggccgacattgatcaggccctgaaagcatgtgcttaatga

SEQ ID NO: 1272 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGIVVGRKALIDRIRLEGLKDMTGAVLSPHDASLLMRGIKTLGLRMDRHCANAQQVAEHLARHPQVELIQYPGLPSFAQYALARRQMRLPGGMIAFELKGGIEAGRRFMNALQLISRAVSLGDAESLAQHPASMTHSSYTPQERKEHDISEGLVRLSVGLEDVDDLLADIDQALKACA

SEQ ID NO: 1273 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcatcgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgtcatccgcaggtcgaactgatccagtatcctggtctgccgagcttcccgcagtatgcattggctcgtcgccaaatgcgcctgccgggtggcatgattgcgtttgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagtctgtgcttaatga

SEQ ID NO: 1274 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVELIQYPGLPSFPQYALARRQMRLPGGMIAFELKGGIEAGRRFMNALQLFSRAVSFGDAESLAQHPASMTHSSYTPQERAEHDISEGLVRLSVGLEDVDDLLADIDQALKVCA

SEQ ID NO: 1275 - DNA, 1200 bp, Artificial Sequence
  PeMGL variant
atgcgtgacagcaacaacaatacgggctttatgacgcgcgccattcaccacggctatgaccccttatcacacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcactgattgatcgcattcgcctggaaggtctgaaagacatgaccggcgcggttctgtcgccgcatgacgcaagcctgctgatgcgcggcatcaagactctggctctgcgtatggatcgccatagcgccaacgcacagcaaattgccgaacatctggcccgccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcctgtgcttaatga

SEQ ID NO: 1276 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHSANAQQIAEHLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1277 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtcacggcgggcttagttgtaggtcgtaaagcgctgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggccgcccatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgattagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1278 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLGLRMDRHCANAQQIAEHLAAHPQVELIQYPGLPSFAQYALARRQMRLPGGMIAFELKGGIEAGRRFMNALQLISRAVSLGDAESLAQHPASMTHSSYTPQERAEHDISEGLVRLSVGLEDVDDLLADIDQALKACA

SEQ ID NO: 1279 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacgtgacggcgggcctggttgtaggtcgtaaagcactgattgatcgcattcgcctggaaggtctgaaagacatgaccggcgcggttctgtcgccgcatgacgcaagcctgctgatgcgcggcatcaagactctggctctgcgtatggatcgccattgcgccaacgcacagcaaattgccgaattcctggccgcccatccgcaggtcgaactgatccagtatcctggtctgccgagcttcaaacagtatgcattggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1280 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDVTAGLVVGRKALIDRIRLEGLKDMTGAVLSPHDASLLMRGIKTLALRMDRHCANAQQIAEFLAAHPQVELIQYPGLPSFKQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1281 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcatcgttgtaggtcgtaaagcactgattgatcgcattcgcctggaaggtctgaaagacatgaccggcgcggttctgtcgccgcatgacgcaagcctgctgatgcgcggcatcaagactctgggtctgcgtatggatcgccattgtgccaacgcacagcaaattgccgaacacctggcccgtcatccgcaggtcgaaattatccagtatcctggtctgccgagcttcaaacagtatcaattggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtaaggagcatgacattagcgaaggactggtccgtctgagcgttggtctggaagacgtggatgatctgctggccgacattgatcaggccctgaaagcatgtgcttaatga

SEQ ID NO: 1282 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVEIIQYPGLPSFKQYQLARRQMRLPGGMIAFELKGGIEAGRRFMNALQLFSRAVSLGDAESLAQHPASMTHSSYTPQERKEHDISEGLVRLSVGLEDVDDLLADIDQALKACA

SEQ ID NO: 1283 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaattcctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1284 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQIAEFLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1285 - DNA, 1200 bp, Artificial Sequence
  PeMGL variant
atgcgtgacagcaacaacaatacgggctttatgacgcgcgccattcaccacggctatgaccccttaagtcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcatcgttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaagttgccgaattcctggcccgtcatccgcaggtcgaactgatccagtatcctggtctgccgagcttcgcccagtatgctttggctcgtcgccaaatgcgcctgccgggtggcatgattgcgtttgagctgaaaggtggcattgaagcgggtcgtcgcttcatgaacgccctgcaactgtttagccgcgctgtctctctgggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1286 - protein, 398 aa, Artificial Sequence
  PeMGL variant
MRDSNNNTGFMTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLRDMTGAVLSPHDASLLMRGIKTLGLRMDRHCANAQQVAEFLARHPQVELIQYPGLPSFAQYALARRQMRLPGGMIAFELKGGIEAGRRFMNALQLFSRAVSLGDAESLAQHPASMTHSSYTPQERAEHDISEGLVRLSVGLEDVDDLLADIDQALKACA

SEQ ID NO: 1287 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1288 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLVMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1289 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtaagcgcgacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1290 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGKRDMTGAVLSPHDASLLMRGIKTLGLRMDRHCANAQQIAEFLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1291 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1292 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQIAEFLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1293 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1294 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1295 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1296 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1297 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgctggagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1298 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLVMRGIKTLGLRMDRHCANAQQIAEHLARHPQVELIQYPGLPSFKQYALARRQMRLPGGMIALELKGGIEAGRRFMNALQLFSRAVSFGDAESLAQHPASMTHSSYTPQERAEHDISEGLVRLSVGLEDVDDLLADIDQALKACA

SEQ ID NO: 1299 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1300 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1301 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtaagcgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1302 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGKRDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1303 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaaattatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1304 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVEIIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1305 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtaagaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1306 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGKKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1307 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaaattatccagtatcctggtctgccgagcttcgcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1308 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVEIIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1309 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1310 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLVMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1311 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1312 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLRDMTGAVLSPHDASLLMRGIKTLGLRMDRHCANAQQIAEHLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1313 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaacagtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1314 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEFLARHPQVELIQYPGLPSFKQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1315 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaaattatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1316 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVEIIQYPGLPSFKQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1317 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1318 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLVMRGIKTLGLRMDRHCANAQQIAEHLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1319 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtaagaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaaattatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1320 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGKKDMTGAVLSPHDASLLMRGIKTLGLRMDRHCANAQQIAEHLARHPQVEIIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1321 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1322 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLVMRGIKTLGLRMDRHCANAQQIAEHLARHPQVELIQYPGLPSFKQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1323 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1324 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEFLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1325 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1326 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFKQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1327 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaatttctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1328 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLVMRGIKTLGLRMDRHCANAQQIAEFLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1329 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1330 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1331 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1332 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLVMRGIKTLGLRMDRHCANAQQIAEHLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1333 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcccgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1334 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLVMRGIKTLGLRMDRHCANAQQIAEHLARHPQVELIQYPGLPSFPQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1335 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtaagaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttcaagcagtatgctttggctcgtcgccaaatgcgcctgccgggtggcatgattgcgctggagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1336 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGKKDMTGAVLSPHDASLLMRGIKTLGLRMDRHCANAQQIAEFLARHPQVELIQYPGLPSFKQYALARRQMRLPGGMIALELKGGIEAGRRFMNALQLFSRAVSFGDAESLAQHPASMTHSSYTPQERAEHDISEGLVRLSVGLEDVDDLLADIDQALKACA

SEQ ID NO: 1337 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtaagaaggacatgaccggcgcggttctgtcgccgcatgacgcaagcctgctgatgcgcggcatcaagactctgggtctgcgtatggatcgccattgtgccaacgcacagcaaattgccgaacatctggcccgccatccgcaggtcgaactgatccagtatcctggtctgccgagcttcgcacagtatgctttggctcgtcgccaaatgcgcctgccgggtggcatgattgcgctggagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1338 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGKKDMTGAVLSPHDASLLMRGIKTLGLRMDRHCANAQQIAEHLARHPQVELIQYPGLPSFAQYALARRQMRLPGGMIALELKGGIEAGRRFMNALQLISRAVSFGDAESLAQHPASMTHSSYTPQERAEHDISEGLVRLSVGLEDVDDLLADIDQALKACA

SEQ ID NO: 1339 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgcgcgacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1340 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLVMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1341 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1342 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1343 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1344 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1345 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1346 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1347 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtaagaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcaagcagtatgctttggctcgtcgccaaatgcgcctgccgggtggcatgattgcgctggagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1348 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGKKDMTGAVLSPHDASLLMRGIKTLGLRMDRHCANAQQIAEHLARHPQVELIQYPGLPSFKQYALARRQMRLPGGMIALELKGGIEAGRRFMNALQLFSRAVSFGDAESLAQHPASMTHSSYTPQERAEHDISEGLVRLSVGLEDVDDLLADIDQALKACA

SEQ ID NO: 1349 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgctggagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1350 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEHLARHPQVELIQYPGLPSFAQYALARRQMRLPGGMIALELKGGIEAGRRFMNALQLFSRAVSFGDAESLAQHPASMTHSSYTPQERAEHDISEGLVRLSVGLEDVDDLLADIDQALKACA

SEQ ID NO: 1351 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgctggagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1352 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIALELKGGIEAGRRFMNALQLFSRAVSFGDAESLAQHPASMTHSSYTPQERAEHDISEGLVRLSVGLEDVDDLLADIDQALKACA

SEQ ID NO: 1353 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtaagaaggacatgaccggcgcggttctgtcgccgcatgacgcaagcctggtgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgctggagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1354 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGKKDMTGAVLSPHDASLVMRGIKTLGLRMDRHCANAQQIAEHLARHPQVELIQYPGLPSFAQYALARRQMRLPGGMIALELKGGIEAGRRFMNALQLFSRAVSFGDAESLAQHPASMTHSSYTPQERAEHDISEGLVRLSVGLEDVDDLLADIDQALKACA

SEQ ID NO: 1355 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgcgcgacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaaattatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgattagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1356 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLRDMTGAVLSPHDASLLMRGIKTLGLRMDRHCANAQQIAEHLARHPQVEIIQYPGLPSFAQYALARRQMRLPGGMIAFELKGGIEAGRRFMNALQLISRAVSFGDAESLAQHPASMTHSSYTPQERAEHDISEGLVRLSVGLEDVDDLLADIDQALKACA

SEQ ID NO: 1357 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtaagaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1358 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGKKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1359 - DNA, 1200 bp, Artificial Sequence
  PeMGL variant
atgcgtgacagcactaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1360 - protein, 398 aa, Artificial Sequence
  PeMGL variant
MRDSTNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1361 - DNA, 1200 bp, Artificial Sequence
  PeMGL variant
atgcgtgacagcaacaacaatacgggctttatgacgcgcgccattcactgtggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1362 - protein, 398 aa, Artificial Sequence
  PeMGL variant
MRDSNNNTGFMTRAIHCGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1363 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgttttgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1364 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRFVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1365 - DNA, 1200 bp, Artificial Sequence
  PeMGL variant
atgcgtgacagcaacaacctgacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1366 - protein, 398 aa, Artificial Sequence
  PeMGL variant
MRDSNNLTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1367 - DNA, 1200 bp, Artificial Sequence
  PeMGL variant
atgcgtgacagcaacaacaatcctggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1368 - protein, 398 aa, Artificial Sequence
  PeMGL variant
MRDSNNNPGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1369 - DNA, 1200 bp, Artificial Sequence
  PeMGL variant
atgcgtgacagcaacaacagtacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1370 - protein, 398 aa, Artificial Sequence
  PeMGL variant
MRDSNNSTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1371 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattggtgcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1372 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIGAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1373 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggtgcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1374 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1375 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaatggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1376 - protein, 398 aa, Artificial Sequence
  PeMGL variant
MRDSNNNTGFMTRAIHHGYDPLKHGGALVPPVYQTATYAFPTVEYGAACFAGEENGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1377 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaatctgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1378 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKSALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1379 - DNA, 1200 bp, Artificial Sequence
  PeMGL variant
atgcgtgacgagaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1380 - protein, 398 aa, Artificial Sequence
  PeMGL variant
MRDENNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1381 - DNA, 1200 bp, Artificial Sequence
  PeMGL variant
atgcgtgagagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1382 - protein, 398 aa, Artificial Sequence
  PeMGL variant
MRESNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1383 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1384 - protein, 398 aa, Artificial Sequence
  PeMGL variant
MRDSNNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1385 - DNA, 1200 bp, Artificial Sequence
  PeMGL variant
atgtgggacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1386 - protein, 398 aa, Artificial Sequence
  PeMGL variant
MWDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1387 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaagagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1388 - protein, 398 aa, Artificial Sequence
  PeMGL variant
MRDSNNNTGFMTRAIHHGYDPLKHGGALVPPVYQTATYAFPTVEYGAACFAGEEEGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1389 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaaggggcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1390 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKGALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1391 - DNA, 1200 bp, Artificial Sequence
  PeMGL variant
atgcgtgacagcaacaacaatgggggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1392 - protein, 398 aa, Artificial Sequence
  PeMGL variant
MRDSNNNGGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1393 - DNA, 1200 bp, Artificial Sequence
  PeMGL variant
atgaaggacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1394 - protein, 398 aa, Artificial Sequence
  PeMGL variant
MKDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1395 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggccaggcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1396 - protein, 398 aa, Artificial Sequence
  PeMGL variant
MRDSNNNTGFMTRAIHHGYDPLKHGGALVPPVYQTATYAFPTVEYGQACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1397 - DNA, 1200 bp, Artificial Sequence
  PeMGL variant
atgcgttctagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1398 - protein, 398 aa, Artificial Sequence
  PeMGL variant
MRSSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1399 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaatctggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1400 - protein, 398 aa, Artificial Sequence
  PeMGL variant
MRDSNNNTGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1401 - DNA, 1200 bp, Artificial Sequence
  PeMGL variant
atgcgtgacgttaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1402 - protein, 398 aa, Artificial Sequence
  PeMGL variant
MRDVNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1403 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattcaggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggcctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1404 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIQAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1405 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgaggccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1406 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVEATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1407 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaccgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1408 - protein, 398 aa, Artificial Sequence
  PeMGL variant
MRDSNNNTGFMTRAIHHGYDPLKHGGALVPPVYQTATYAFPTVEYGAACFAGEEPGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1409 - DNA, 1200 bp, Artificial Sequence
  PeMGL variant
atgcgtgacagcaacaacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1410 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1411 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgatctgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1412 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVDLIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1413 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatgaatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1414 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMNRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1415 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctgtatggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1416 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLYGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1417 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctgcggggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1418 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLRGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1419 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatcaagtatcctggtctgagtagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1420 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIKYPGLSSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1421 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagtctattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1422 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQSIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1423 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1424 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLHGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1425 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggttgggacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1426 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGWDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1427 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctggagagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1428 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLESFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1429 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcaagccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1430 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRKPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1431 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgactctgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1432 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALTLFSRAVSFGDAESLAQHPASMTHSSYTPQERAEHDISEGLVRLSVGLEDVDDLLADIDQALKACA

SEQ ID NO: 1433 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggggggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1434 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLGGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1435 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtaagtataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1436 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSKYTPQERAEHDISEGLVRLSVGLEDVDDLLADIDQALKACA

SEQ ID NO: 1437 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtaggtataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1438 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSRYTPQERAEHDISEGLVRLSVGLEDVDDLLADIDQALKACA

SEQ ID NO: 1439 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcgctccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1440 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRAPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1441 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagttgttataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1442 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSCYTPQERAEHDISEGLVRLSVGLEDVDDLLADIDQALKACA

SEQ ID NO: 1443 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcggattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1444 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQRIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1445 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatgcgtcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1446 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMRRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1447 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcgttgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1448 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGVEAGRRFMNALQLFSRAVSFGDAESLAQHPASMTHSSYTPQERAEHDISEGLVRLSVGLEDVDDLLADIDQALKACA

SEQ ID NO: 1449 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacattgatgatctgctggccgacattgatcaggccctgaaagcatgtgcttaatga

SEQ ID NO: 1450 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDIDDLLADIDQALKACA

SEQ ID NO: 1451 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggcgggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1452 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLAGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1453 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctgaagggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1454 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLKGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1455 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctgctgggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1456 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLLGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1457 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgccgtgaaggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1458 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRREGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1459 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcttagttgtaggtcgtaaagcactgattgatcgcattcgcctggtgggtctgaaggacatgaccggcgcggttctgtcgccgcatgacgcaagcctgctgatgcgcggcatcaagactctgggtctgcgtatggatcgccattgtgccaacgcacagcaaattgccgaacacctggcccgccatccgcaggtcgaactgatccagtatcctggtctgccgagcttcgcacagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1460 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLVGLKDMTGAVLSPHDASLLMRGIKTLGLRMDRHCANAQQIAEHLARHPQVELIQYPGLPSFAQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1461 - DNA, 1194 bp, Artificial Sequence
  PeMGL variant
atgcgtgacagcactaacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1462 - protein, 398 aa, Artificial Sequence
  PeMGL variant
MRDSTNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1463 - DNA, 1194 bp, Artificial Sequence
  PeMGL variant
atgcgtgacagcactaacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1464 - protein, 398 aa, Artificial Sequence
  PeMGL variant
MRDSTNNTGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1465 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtgcgggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1466 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRAGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1467 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaccgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1468 - protein, 398 aa, Artificial Sequence
  PeMGL variant
MRDSNNNTGFMTRAIHHGYDPLKHGGALVPPVYQTATYAFPTVEYGAACFAGEEPGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1469 - DNA, 1194 bp, Artificial Sequence
  PeMGL variant
atgcgtgacagcactaacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtcatggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1470 - protein, 398 aa, Artificial Sequence
  PeMGL variant
MRDSTNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRHGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1471 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaagcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1472 - protein, 398 aa, Artificial Sequence
  PeMGL variant
MRDSNNNSGFMTRAIHHGYDPLKHGGALVPPVYQTATYAFPTVEYGAACFAGEEAGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1473 - DNA, 1194 bp, Artificial Sequence
  PeMGL variant
atgcgtgacagcactaacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1474 - protein, 398 aa, Artificial Sequence
  PeMGL variant
MRDSTNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1475 - DNA, 1194 bp, Artificial Sequence
  PeMGL variant
atgcgtgacagcactaacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaagcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtacgggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1476 - protein, 398 aa, Artificial Sequence
  PeMGL variant
MRDSTNNSGFMTRAIHHGYDPLKHGGALVPPVYQTATYAFPTVEYGAACFAGEEAGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRTGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1477 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1478 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1479 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtcatggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1480 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRHGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1481 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgtcctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1482 - protein, 398 aa, Artificial Sequence
  PeMGL variant
MRDSNNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHVLNIVVDNTLCTPYLQRPLELGADLVVHSATKYLSGHGDLTAGIVVGRKALIDRIRLHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1483 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1484 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1485 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaccgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1486 - protein, 398 aa, Artificial Sequence
  PeMGL variant
MRDSNNNTGFMTRAIHHGYDPLKHGGALVPPVYQTATYAFPTVEYGAACFAGEEPGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1487 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1488 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1489 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaagcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1490 - protein, 398 aa, Artificial Sequence
  PeMGL variant
MRDSNNNTGFMTRAIHHGYDPLKHGGALVPPVYQTATYAFPTVEYGAACFAGEEAGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1491 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1492 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1493 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1494 - protein, 398 aa, Artificial Sequence
  PeMGL variant
MRDSNNNTGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1495 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1496 - protein, 398 aa, Artificial Sequence
  PeMGL variant
MRDSNNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1497 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1498 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLHGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1499 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1500 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1501 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1502 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1503 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcgcggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1504 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLRGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1505 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtcgcggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1506 - protein, 398 aa, Artificial Sequence
  PeMGL variant
MRDSNNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRRGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1507 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtgagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1508 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRREGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1509 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1510 - protein, 398 aa, Artificial Sequence
  PeMGL variant
MRDSNNNTGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1511 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtgagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1512 - protein, 398 aa, Artificial Sequence
  PeMGL variant
MRDSNNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRREGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1513 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1514 - protein, 398 aa, Artificial Sequence
  PeMGL variant
MRDSNNNSGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1515 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaccgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgggcggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1516 - protein, 398 aa, Artificial Sequence
  PeMGL variant
MRDSNNNTGFMTRAIHHGYDPLKHGGALVPPVYQTATYAFPTVEYGAACMAGEEPGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLGGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1517 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtggcggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1518 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRGGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1519 - DNA, 1194 bp, Artificial Sequence
  PeMGL variant
atgcgtgacagcactaacaatagtggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1520 - protein, 398 aa, Artificial Sequence
  PeMGL variant
MRDSTNNSGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1521 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgaagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1522 - protein, 398 aa, Artificial Sequence
  PeMGL variant
MRDSNNNSGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLKGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1523 - DNA, 1194 bp, Artificial Sequence
  PeMGL variant
atgcgtgacagcactaacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtacgggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1524 - protein, 398 aa, Artificial Sequence
  PeMGL variant
MRDSTNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRTGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1525 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgacgggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1526 - protein, 398 aa, Artificial Sequence
  PeMGL variant
MRDSNNNTGFMTRAIHHGYDPLKHGGALVPPVYQTATYAFPTVEYGAACMAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLTGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1527 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtgagggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1528 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRREGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1529 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtcgcggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1530 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRRGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1531 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcgcggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1532 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLRGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1533 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1534 - protein, 398 aa, Artificial Sequence
  PeMGL variant
MRDSNNNSGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1535 - DNA, 1194 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtacgggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1536 - protein, 398 aa, Artificial Sequence
  PeMGL variant
MRDSNNNTGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRTGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1537 - DNA, 1194 bp, Artificial Sequence
  PeMGL variant
atgcgtgacagcactaacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaatttggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1538 - protein, 398 aa, Artificial Sequence
  PeMGL variant
MRDSTNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1539 - DNA, 1194 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcatggcaggcgaagaaccgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctgcatggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1540 - protein, 398 aa, Artificial Sequence
  PeMGL variant
MRDSNNNSGFMTRAIHHGYDPLKHGGALVPPVYQTATYAFPTVEYGAACMAGEEPGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLHGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1541 - DNA, 1194 bp, Artificial Sequence
  PeMGL variant
atgcgtgacagcaataacaatactggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaaaaaggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaaggttcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgct

SEQ ID NO: 1542 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKVRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1543 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctggctctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1544 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLALRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1545 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccaatatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagaacatggtattagcgaaggactggtccgtctgagcgttggtctggaagacgtggatgatctgctggccgacattgatcaggccctgaaagcatgtgcttaatga

SEQ ID NO: 1546 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHGISEGLVRLSVGLEDVDDLLADIDQALKACA

SEQ ID NO: 1547 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacacctattgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaatcgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagaacatggtattagcgaaggactggtccgtctgagcgttggtctggaagacgtggatgatctgctggccgacattgatcaggccctgaaagcatgtgcttaatga

SEQ ID NO: 1548 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTYCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHGISEGLVRLSVGLEDVDDLLADIDQALKACA

SEQ ID NO: 1549 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaatcgccgaatttctggcccgccagccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1550 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARQPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1551 - DNA, 1200 bp, Artificial Sequence
  PeMGL variant
atgcgtgacagcaacaacaatacgggctttatgacgcgcgccattcaccacggctatgaccccttaagccacggcggtgccctcgttccgccggtgtatcagaccgccacctatgcatttccaaccgtggagtatggcgctgcatgctttgcaggcgaagaaaaaggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctgcaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcctggttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1552 - protein, 398 aa, Artificial Sequence
  PeMGL variant
MRDSNNNTGFMTRAIHHGYDPLSHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLQALKAALTPKTRMIYFETPANPNMRLVDIAAVVDATRGHDLNIVVDNTLCTPYLQRPLELGADLVVHSATKYLSGHGDLTAGLVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1553 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaagcactgaaagccgcactgacccctaagacccgcatgatctactttgaaaccccggcgaatccgaacatgcgcctcgttgacattgcggcggtggtagacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaatcgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1554 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDITAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1555 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacatcacggcgggcctggttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagtcgccgaacatctggcccgccagccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagaacatggtattagcgaaggactggtccgtctgagcgttggtctggaagacgtggatgatctgctggccgacattgatcaggccctgaaagcatgtgcttaatga

SEQ ID NO: 1556 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDITAGLVVGRKALIDRIRLEGLKDMTGAVLSPHDASLLMRGIKTLGLRMDRHCANAQQVAEHLARQPQVELIQYPGLPSFSQYALARRQMRLPGGMIAFELKGGIEAGRRFMNALQLFSRAVSFGDAESLAQHPASMTHSSYTPQERAEHGISEGLVRLSVGLEDVDDLLADIDQALKACA

SEQ ID NO: 1557 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggcagacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctggctctgcgtatggatcgccattgtgccaacgcacagcaaatcgccgaatttctggcccgccagccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagaacatggtattagcgaaggactggtccgtctgagcgttggtctggaagacgtggatgatctgctggccgacattgatcaggccctgaaagcatgtgcttaatga

SEQ ID NO: 1558 - protein, 398 aa, Artificial Sequence
  PeMGL variant
MRDSNNNTGFMTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVADATRGHDLNIVVDNTLCTPYLQRPLELGADLVVHSATKYLSGHGDLTAGIVVGRKALIDRIRLEGLKDMTGAVLSPHDASLLMRGIKTLALRMDRHCANAQQIAEFLARQPQVELIQYPGLPSFSQYALARRQMRLPGGMIAFELKGGIEAGRRFMNALQLFSRAVSFGDAESLAQHPASMTHSSYTPQERAEHGISEGLVRLSVGLEDVDDLLADIDQALKACA

SEQ ID NO: 1559 - DNA, 1200 bp, Artificial Sequence
  PeMGL variant
atgcgtgacagcaacaacaatacgggctttagtacgcgcgccattcaccacggctatgaccccttaaagcacggcggtgccctcgttccgccggtgtatcagaccgccacctatgcatttccaaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaagcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccaatatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagaacatggtattagcgaaggactggtccgtctgagcgttggtctggaagacgtggatgatctgctggccgacattgatcaggccctgaaagcatgtgcttaatga

SEQ ID NO: 1560 - protein, 398 aa, Artificial Sequence
  PeMGL variant
MRDSNNNTGFSTRAIHHGYDPLKHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHGISEGLVRLSVGLEDVDDLLADIDQALKACA

SEQ ID NO: 1561 - DNA, 1200 bp, Artificial Sequence
  PeMGL variant
atgcgtgacagcaacaacaatacgggctttatgacgcgcgccattcaccacggctatgaccccttaaagcacggcggtgccctcgttccgccggtgtatcagaccgccacctatgcatttccaaccgtggagtatggcgctgcatgctttgcaggcgaagaaaaaggtcacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1562 - protein, 398 aa, Artificial Sequence
  PeMGL variant
MRDSNNNTGFMTRAIHHGYDPLKHGGALVPPVYQTATYAFPTVEYGAACFAGEEKGHFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1563 - DNA, 1200 bp, Artificial Sequence
  PeMGL variant
atgcgtgacagcaacaacaatacgggctttagtacgcgcgccattcaccacggctatgaccccttaagccacggcggtgccctcgttccgccggtgtatcagaccgccacctatgcatttcctaccgtggagtatggcgctgcatgctttgcaggcgaagaaaagggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagatccgtcatgttgatctgaatgatctggaggcactgaaagccgcactgacccctaagacccgcatgatctactttgaaaccccggcgaatccgaacatgcgcctcgttgacattgcggcggtggtagacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgcctggaaggtctgaaggacatgaccggcgcggttctgtcgccgcatgacgcaagcctgctgatgcgcggcatcaagactctgggtctgcgtatggatcgccattgtgccaacgcacagcaagtcgccgaacatctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagaacatggtattagcgaaggactggtccgtctgagcgttggtctggaagacgtggatgatctgctggccgacattgatcaggccctgaaagcatgtgcttaatga

SEQ ID NO: 1564 - protein, 398 aa, Artificial Sequence
  PeMGL variant
MRDSNNNTGFSTRAIHHGYDPLSHGGALVPPVYQTATYAFPTVEYGAACFAGEEKGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRLEGLKDMTGAVLSPHDASLLMRGIKTLGLRMDRHCANAQQVAEHLARHPQVELIQYPGLPSFSQYALARRQMRLPGGMIAFELKGGIEAGRRFMNALQLFSRAVSFGDAESLAQHPASMTHSSYTPQERAEHGISEGLVRLSVGLEDVDDLLADIDQALKACA

SEQ ID NO: 1565 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgattgcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1566 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLIAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1567 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccccgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1568 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTPCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1569 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgctgacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1570 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGALTSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1571 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccagttgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1572 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTSCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1573 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggggggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1574 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTGGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1575 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatcttttttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1576 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIFFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1577 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1578 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1579 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcattggtaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1580 - protein, 398 aa, Artificial Sequence
  PeMGL variant
MRDSNNNSGFMTRAIHHGYDPLKHGGALVPPVYQTATYAFPTVEYGAACFAGEESGYFYSRIGNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1581 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatgtgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1582 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHVQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1583 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgaagctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1584 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMKLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1585 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatgagcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1586 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHEQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1587 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagggctgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1588 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKGLIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1589 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatagtcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1590 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHSQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1591 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccactttggctgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1592 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLWLGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1593 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaggaacgtgcagagcatgacattagcgaaggactggtccgtctgagcgttggtctggaagacgtggatgatctgctggccgacattgatcaggccctgaaagcatgtgcttaatga

SEQ ID NO: 1594 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVDDLLADIDQALKACA

SEQ ID NO: 1595 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgtcgctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1596 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMSLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1597 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgggttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1598 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYGLARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1599 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagcgggctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1600 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQRALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1601 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttccggcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1602 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFRQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1603 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgcgtgcatgtgcttaatga

SEQ ID NO: 1604 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALRACA

SEQ ID NO: 1605 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattagggaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1606 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIREFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1607 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccgtgctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1608 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAVLEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1609 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctggcggcatgtgcttaatga

SEQ ID NO: 1610 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALAACA

SEQ ID NO: 1611 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcagattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1612 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDQIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1613 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtgggggatctgctggccgacattgatcaggccctgaaagcatgtgcttaatga

SEQ ID NO: 1614 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVGDLLADIDQALKACA

SEQ ID NO: 1615 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatgtgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1616 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDVIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1617 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcatttctgcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1618 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGISAGRRFMNALQLFSRAVSFGDAESLAQHPASMTHSSYTPQERAEHDISEGLVRLSVGLEDVDDLLADIDQALKACA

SEQ ID NO: 1619 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaacagtgtgcttaatga

SEQ ID NO: 1620 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKQCA

SEQ ID NO: 1621 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcggtcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1622 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFGQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1623 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccagcatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1624 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLAQHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1625 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcgcgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1626 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASALMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1627 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgtgacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1628 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDVTRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1629 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtagggagcatgacattagcgaaggactggtccgtctgagcgttggtctggaagacgtggatgatctgctggccgacattgatcaggccctgaaagcatgtgcttaatga

SEQ ID NO: 1630 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERREHDISEGLVRLSVGLEDVDDLLADIDQALKACA

SEQ ID NO: 1631 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaacgttgtgcttaatga

SEQ ID NO: 1632 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKRCA

SEQ ID NO: 1633 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgctgctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1634 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMLLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1635 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtggttaatga

SEQ ID NO: 1636 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACG

SEQ ID NO: 1637 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctgtcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1638 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFCQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1639 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggtggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1640 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLVALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1641 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcagggctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1642 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDAGLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1643 - DNA, 1200 bp, Artificial Sequence
  PeMGL variant
atgcgtgacagcaatcctaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1644 - protein, 398 aa, Artificial Sequence
  PeMGL variant
MRDSNPNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1645 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatgggattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1646 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDGIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1647 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtgcaggatctgctggccgacattgatcaggccctgaaagcatgtgcttaatga

SEQ ID NO: 1648 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVQDLLADIDQALKACA

SEQ ID NO: 1649 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggagtgtggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1650 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGECGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1651 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgattcgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1652 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDSIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1653 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctaagcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1654 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALAKRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1655 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1656 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDMIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1657 - DNA, 1200 bp, Artificial Sequence
  PeMGL variant
atgcgtgacagcaataacaatagtaggtttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1658 - protein, 398 aa, Artificial Sequence
  PeMGL variant
MRDSNNNSRFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1659 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatagtttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1660 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYSLARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1661 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctgttcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1662 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALAVRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1663 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1664 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFNQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1665 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggcggatctgctggccgacattgatcaggccctgaaagcatgtgcttaatga

SEQ ID NO: 1666 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVADLLADIDQALKACA

SEQ ID NO: 1667 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatagcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgaaagcatgtgcttaatga

SEQ ID NO: 1668 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDSIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVDDLLADIDQALKACA

SEQ ID NO: 1669 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgaaagcatgtgcttaatga

SEQ ID NO: 1670 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDMIRRKGLKDMTGAVLSPHDASLLMRGIKTLGLRMERHCANAQQIAEFLARHPQVELIQYPGLPSFNQYALARRQMRLPGGMIAFELKGGIEAGRRFMNALQLFSRAVSFGDAESLAQHPASMTHSSYTPEERAEHDISEGLVRLSVGLEDVDDLLADIDQALKACA

SEQ ID NO: 1671 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtgggtgatctgctggccgacattgatcaggccctgaaagcatgtgcctaatga

SEQ ID NO: 1672 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFNQYALARRQMRLPGGMIAFELKGGIEAGRRFMNALQLFSRAVSFGDAESLAQHPASMTHSSYTPEERAEHDISEGLVRLSVGLEDVGDLLADIDQALKACA

SEQ ID NO: 1673 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtggctaatga

SEQ ID NO: 1674 - protein, 398 aa, Artificial Sequence; identical to SEQ ID NO: 1636
  PeMGL variant

SEQ ID NO: 1675 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttccgtcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1676 - protein, 398 aa, Artificial Sequence; identical to SEQ ID NO: 1602
  PeMGL variant

SEQ ID NO: 1677 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtgggtgatctgctggccgacattgatcaggccctgcgtgcatgtggctaatga

SEQ ID NO: 1678 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVGDLLADIDQALRACG

SEQ ID NO: 1679 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccacccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgcgtgcatgtgcctaatga

SEQ ID NO: 1680 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVDDLLADIDQALRACA

SEQ ID NO: 1681 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgaaactgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtgggtgatctgctggccgacattgatcaggccctgcgtgcatgtgcctaatga

SEQ ID NO: 1682 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLARHPQVELIQYPGLPSFSQYALARRQMKLPGGMIAFELKGGIEAGRRFMNALQLFSRAVSFGDAESLAQHPASMTHSSYTPQERAEHDISEGLVRLSVGLEDVGDLLADIDQALRACA

SEQ ID NO: 1683 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtattcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgcgtgcatgtgcctaatga

SEQ ID NO: 1684 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDMIRRKGLKDMTGAVLSPHDASLLMRGIKTLGLRMERHCANAQQIAEFLARHPQVELIQYPGLPSFNQYSLARRQMRLPGGMIAFELKGGIEAGRRFMNALQLFSRAVSFGDAESLAQHPASMTHSSYTPQERAEHDISEGLVRLSVGLEDVDDLLADIDQALRACA

SEQ ID NO: 1685 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtgggtgatctgctggccgacattgatcaggccctgcgtgcatgtgcctaatga

SEQ ID NO: 1686 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDMIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVGDLLADIDQALRACA

SEQ ID NO: 1687 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtgggtgatctgctggccgacattgatcaggccctgcgtgcatgtgcctaatga

SEQ ID NO: 1688 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDQIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVGDLLADIDQALRACA

SEQ ID NO: 1689 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatagcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtgggtgatctgctggccgacattgatcaggccctgcgtgcatgtgcttaatga

SEQ ID NO: 1690 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDSIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVGDLLADIDQALRACA

SEQ ID NO: 1691 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgcgtgcatgtggctaatga

SEQ ID NO: 1692 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDMIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVDDLLADIDQALRACG

SEQ ID NO: 1693 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgaaagcatgtgcttaatga

SEQ ID NO: 1694 - protein, 398 aa, Artificial Sequence; identical to SEQ ID NO: 1578
  PeMGL variant

SEQ ID NO: 1695 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggtccgccatccgcaggtcgaactgatccagtatcctggtctgccgagcttcagtcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgaaagcatgtgcttaatga

SEQ ID NO: 1696 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLVRHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1697 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccatgtgtaccccgtatctgcaacgtccacttgaactgggtgccgacctggtagttcactcagccaccaagtacctgagcggtcatggtgacctgacggcgggcattgttgtaggtcgtaaagcagtgattgatagcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgcgtgcatgtggctaatga

SEQ ID NO: 1698 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTMCTPYLQRPLELGADLVVHSATKYLSGHGDLTAGIVVGRKAVIDSIRRKGLKDMTGAVLSPHDASLLMRGIKTLGLRMERHCANAQQIAEFLARHPQVELIQYPGLPSFNQYALARRQMRLPGGMIAFELKGGIEAGRRFMNALQLFSRAVSFGDAESLAQHPASMTHSSYTPQERAEHDISEGLVRLSVGLEDVDDLLADIDQALRACG

SEQ ID NO: 1699 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgaaagcatgtgcttaatga

SEQ ID NO: 1700 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLARHPQVELIQYPGLPSFNQYALARRQMRLPGGMIAFELKGGIEAGRRFMNALQLFSRAVSFGDAESLAQHPASMTHSSYTPEERAEHDISEGLVRLSVGLEDVDDLLADIDQALKACA

SEQ ID NO: 1701 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgcgtgcatgtgcctaatga

SEQ ID NO: 1702 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDMIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVDDLLADIDQALRACA

SEQ ID NO: 1703 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtatgcgttggctcgtcgccaaatgaaactgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtgggtgatctgctggccgacattgatcaggccctgcgtgcatgtgcctaatga

SEQ ID NO: 1704 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDMIRRKGLKDMTGAVLSPHDASLLMRGIKTLGLRMERHCANAQQIAEFLARHPQVELIQYPGLPSFNQYALARRQMKLPGGMIAFELKGGIEAGRRFMNALQLFSRAVSFGDAESLAQHPASMTHSSYTPQERAEHDISEGLVRLSVGLEDVGDLLADIDQALRACA

SEQ ID NO: 1705 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatagcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgcgtgcatgtgcctaatga

SEQ ID NO: 1706 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDSIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVDDLLADIDQALRACA

SEQ ID NO: 1707 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctatcagtattctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcttaatga

SEQ ID NO: 1708 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFYQYSLARRQMRLPGGMIAFELKGGIEAGRRFMNALQLFSRAVSFGDAESLAQHPASMTHSSYTPQERAEHDISEGLVRLSVGLEDVDDLLADIDQALKACA

SEQ ID NO: 1709 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatatgattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgaaagcatgtgcctaatga

SEQ ID NO: 1710 - protein, 398 aa, Artificial Sequence; identical to SEQ ID NO: 1656
  PeMGL variant

SEQ ID NO: 1711 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtgggtgatctgctggccgacattgatcaggccctgaaagcatgtggctaatga

SEQ ID NO: 1712 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVGDLLADIDQALKACG

SEQ ID NO: 1713 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgcgtgcatgtggctaatga

SEQ ID NO: 1714 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALRACG

SEQ ID NO: 1715 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtattcgttggctcgtcgccaaatgaaactgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtgggtgatctgctggccgacattgatcaggccctgaaagcatgtgcttaatga

SEQ ID NO: 1716 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFNQYSLARRQMKLPGGMIAFELKGGIEAGRRFMNALQLFSRAVSFGDAESLAQHPASMTHSSYTPQERAEHDISEGLVRLSVGLEDVGDLLADIDQALKACA

SEQ ID NO: 1717 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttccgtcagtatgcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgaaagcatgtgcttaatga

SEQ ID NO: 1718 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDQIRRKGLKDMTGAVLSPHDASLLMRGIKTLGLRMERHCANAQQIAEFLARHPQVELIQYPGLPSFRQYALARRQMRLPGGMIAFELKGGIEAGRRFMNALQLFSRAVSFGDAESLAQHPASMTHSSYTPEERAEHDISEGLVRLSVGLEDVDDLLADIDQALKACA

SEQ ID NO: 1719 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttccgtcagtattcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtgggtgatctgctggccgacattgatcaggccctgcgtgcatgtgcctaatga

SEQ ID NO: 1720 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLARHPQVELIQYPGLPSFRQYSLARRQMRLPGGMIAFELKGGIEAGRRFMNALQLFSRAVSFGDAESLAQHPASMTHSSYTPEERAEHDISEGLVRLSVGLEDVGDLLADIDQALRACA

SEQ ID NO: 1721 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatagcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtattcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtgggtgatctgctggccgacattgatcaggccctgcgtgcatgtgcctaatga

SEQ ID NO: 1722 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDSIRRKGLKDMTGAVLSPHDASLLMRGIKTLGLRMERHCANAQQIAEFLARHPQVELIQYPGLPSFNQYSLARRQMRLPGGMIAFELKGGIEAGRRFMNALQLFSRAVSFGDAESLAQHPASMTHSSYTPEERAEHDISEGLVRLSVGLEDVGDLLADIDQALRACA

SEQ ID NO: 1723 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcgcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtgggtgatctgctggccgacattgatcaggccctgaaagcatgtgcttaatga

SEQ ID NO: 1724 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDRIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPEERAEHDISEGLVRLSVGLEDVGDLLADIDQALKACA

SEQ ID NO: 1725 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgaaagcatgtgcttaatga

SEQ ID NO: 1726 - protein, 398 aa, Artificial Sequence; identical to SEQ ID NO: 1612
  PeMGL variant

SEQ ID NO: 1727 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggcgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatggcattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttctcgcagtatgctttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaggaacgtgcagagcatgacattagcgaaggactggtccgtctgagcgttggtctggaagacgtggatgatctgctggccgacattgatcaggccctgcgtgcatgtgcctaatga

SEQ ID NO: 1728 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDGIRRKGLKDMTGAVLSPHDASLLMRGIKTLGLRMERHCANAQQIAEFLARHPQVELIQYPGLPSFSQYALARRQMRLPGGMIAFELKGGIEAGRRFMNALQLFSRAVSFGDAESLAQHPASMTHSSYTPQERAEHDISEGLVRLSVGLEDVDDLLADIDQALRACA

SEQ ID NO: 1729 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcactgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtattcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccagaagaacgtgcagagcatgacattagcgaaggactggtccgtctgagcgttggtctggaagacgtggatgatctgctggccgacattgatcaggccctgaaagcatgtgcttaatga

SEQ ID NO: 1730 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKALIDQIRRKGLKDMTGAVLSPHDASLLMRGIKTLGLRMERHCANAQQIAEFLARHPQVELIQYPGLPSFNQYSLARRQMRLPGGMIAFELKGGIEAGRRFMNALQLFSRAVSFGDAESLAQHPASMTHSSYTPEERAEHDISEGLVRLSVGLEDVDDLLADIDQALKACA

SEQ ID NO: 1731 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttccgtcagtattcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgcgtgcatgtgcctaatga

SEQ ID NO: 1732 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLARHPQVELIQYPGLPSFRQYSLARRQMRLPGGMIAFELKGGIEAGRRFMNALQLFSRAVSFGDAESLAQHPASMTHSSYTPQERAEHDISEGLVRLSVGLEDVDDLLADIDQALRACA

SEQ ID NO: 1733 - DNA, 1200 bp, Artificial Sequence
  PeMGL variant
atgcgtgacagcaataacaatagtggctttatgacgcgcgccattcaccacggctatgaccccttaaagcacggcggtgccctcgttccgccggtgtatcagaccgccacctatgcatttccaaccgtggagtatggcgctgcatgcttcgcaggcgaagaatcgggttacttctactctcgcatttctaatccgacactggccatcctggaacagcgcatggcaagcctggaaggtggggaggctggactggccctggcctcaggtatgggcgcgattacctcgaccctctggactctgctgcgccctggtgacgagctgattgtgggtcgcaccctgtatggatgtacgtttgcctatctgcaccacggcattggcgaattcggtgtgaagattcgtcatgttgatctgaatgatctggaggcactgaaagccgcactgacccctaagacccgcatgatctactttgaaaccccggcgaatccgaacatgcgcctcgttgacattgcggcggtggttgacgccacccgcggtcatgacctgaacattgttgtagataacaccctgtgtaccccgtatctgcaacgtccacttgaactgggtgccgacctggtagttcactcagccaccaagtacctgagcggtcatggtgacctgacggcgggcattgttgtaggtcgtaaagcagtgattgatcaaattcgccgtaagggtctgaaggacatgaccggcgcggttctgtcgccgcatgacgcaagcctgctgatgcgcggcatcaagactctgggtctgcgtatggagcgccattgtgccaacgcacagcaaattgccgaatttctggcccgccatccgcaggtcgaactgatccagtatcctggtctgccgagcttcaatcagtattcgttggctcgtcgccaaatgcgcctgccgggtggcatgattgcgttcgagctgaaaggtggcattgaagcgggtcgtcgcttcatgaacgccctgcaactgtttagccgcgctgtctctttcggtgatgcggagagcctggcccagcatccggcaagcatgacccacagtagctataccccacaagaacgtgcagagcatgacattagcgaaggactggtccgtctgagcgttggtctggaagacgtggatgatctgctggccgacattgatcaggccctgcgtgcatgtgcctaatga

SEQ ID NO: 1734 - protein, 398 aa, Artificial Sequence
  PeMGL variant
MRDSNNNSGFMTRAIHHGYDPLKHGGALVPPVYQTATYAFPTVEYGAACFAGEESGYFYSRISNPTLAILEQRMASLEGGEAGLALASGMGAITSTLWTLLRPGDELIVGRTLYGCTFAYLHHGIGEFGVKIRHVDLNDLEALKAALTPKTRMIYFETPANPNMRLVDIAAVVDATRGHDLNIVVDNTLCTPYLQRPLELGADLVVHSATKYLSGHGDLTAGIVVGRKAVIDQIRRKGLKDMTGAVLSPHDASLLMRGIKTLGLRMERHCANAQQIAEFLARHPQVELIQYPGLPSFNQYSLARRQMRLPGGMIAFELKGGIEAGRRFMNALQLFSRAVSFGDAESLAQHPASMTHSSYTPQERAEHDISEGLVRLSVGLEDVDDLLADIDQALRACA

What is claimed is:

1. A recombinant methionine gamma lyase comprising a polypeptide sequence comprising at least 85% sequence identity to the reference sequence of SEQ ID NO: 1488, wherein the polypeptide sequence comprises at least a substitution 189I/L/M/P/S, 69I/R/W, 237K/A/G/H/L/R/T/Y, 236A/C/R, or 341F, or combinations thereof, wherein the amino acid positions are relative to the reference sequence of SEQ ID NO: 2.

2. The recombinant methionine gamma lyase of claim 1, comprising a polypeptide sequence comprising at least 90%, 91%, 92%, 93%, or 94% sequence identity to the reference sequence of SEQ ID NO: 1488.

3. The recombinant methionine gamma lyase of claim 1, comprising a polypeptide sequence comprising at least 95%, 96%, 97%, or 98% sequence identity to the reference sequence of SEQ ID NO: 1488.

4. The recombinant methionine gamma lyase of claim 1, comprising a polypeptide sequence comprising at least 99%, sequence identity to the reference sequence of SEQ ID NO: 1488.

5. The recombinant methionine gamma lyase of claim 1, wherein the polypeptide sequence of the recombinant methionine gamma lyase comprises at least the substitution 189I/L/M/P/S.

6. The recombinant methionine gamma lyase of claim 1, wherein the polypeptide sequence of the recombinant methionine gamma lyase comprises at least the substitution 69I/R/W.

7. The recombinant methionine gamma lyase of claim 1, wherein the polypeptide sequence of the recombinant methionine gamma lyase comprises at least the substitution 237K/A/G/H/L/R/T/Y.

8. The recombinant methionine gamma lyase of claim 7 wherein the polypeptide sequence of the recombinant methionine gamma lyase comprises at least the substitution 237K.

9. The recombinant methionine gamma lyase of claim 1, wherein the polypeptide sequence of the recombinant methionine gamma lyase comprises at least the substitution 236A/C/R.

10. The recombinant methionine gamma lyase of claim 1, wherein the polypeptide sequence of the recombinant methionine gamma lyase comprises at least the substitution 341F.

11. The recombinant methionine gamma lyase of claim 1, wherein the polypeptide sequence of the recombinant methionine gamma lyase comprises at least the substitution 189I/L, 69I/R/W, 237K, 236R, or 341F, or 57Y, or combinations thereof.

12. The recombinant methionine gamma lyase of claim 1, wherein the polypeptide sequence of the recombinant methionine gamma lyase further comprises at least a substitution at position 8, 11, 23, 55, 141, 165, 173, 219, 223, 263, 267, 276, 279, 283, 290, 298, 304, 334, 344, 366, or 368, or combinations thereof, wherein the amino acid positions are relative to the reference sequence of SEQ ID NO: 2.

13. The recombinant methionine gamma lyase of claim 1, wherein the polypeptide sequence of the recombinant methionine gamma lyase further comprises at least a substitution 8S, 11M, 23K, 55K/S, 141E, 165R, 173V, 219VL, 223I, 263G, 267E, 276I, 279F, 283H, 290A/Q, 298S, 304R, 334L, 344T, 366E, or 368D, or combinations thereof, wherein the amino acid positions are relative to the reference sequence of SEQ ID NO: 2.

14. The recombinant methionine gamma lyase of claim 1, wherein the polypeptide sequence of the recombinant methionine gamma lyase comprises at least a substitution set:

8S/11M/23K/55S/57Y/69I/141E/165R/173V/189L/ 219L/223I/233S/236R/237K/263G/267E/276I/279F/ 283H/290Q/298S/304R/341F/362E/366E/368D, 8S/11M/23K/55S/57Y/69I/141E/165R/173V/189L/ 219L/223I/233M/236R/237K/263G/267E/276I/279F/ 283H/290Q/298N/304R/341F/362E/366E/368D, 8S/11M/23K/55S/57Y/69I/141E/165R/173V/189L/ 219L/223I/236R/237K/263G/267E/276I/279F/283H/ 290Q/298N/304R/341F/362E/366E/368D/384G, 8S/11M/23K/55S/57Y/69I/141E/165R/173V/189L/ 219L/223I/236R/237K/263G/267E/276I/279F/283H/ 290Q/298S/304R/341F/366E/368D/398G, 8S/11M/ 23K/55S/57Y/69I/141E/165R/173V/189L/219L/223I/ 236R/237K/263G/267E/276I/279F/283H/290Q/298R/ 304R/341F/366E/368D, 8S/11M/23K/55S/57Y/69I/ 141E/165R/173V/189L/219L/223I/230V/233Q/236R/ 237K/263G/267E/276I/279F/283H/290Q/298S/304R/ 341F/366E/368D/384G/395R/398G, 8S/11M/23K/ 55S/57Y/69I/141E/165R/173V/189L/219L/223I/ 230V/236R/237K/263G/267E/276I/279F/283H/290Q/ 298S/304R/341F/362E/366E/368D/395R, 8S/11M/ 23K/55S/57Y/69I/141E/165R/173V/189L/219L/223I/ 230V/233Q/236R/237K/263G/267E/276I/279F/283H/ 290Q/298S/304R/308K/341F/366E/368D/384G/395R, 8S/11M/23K/55S/57Y/69I/141E/165R/173V/189L/ 219L/223I/230V/233M/236R/237K/263G/267E/276I/ 279F/283H/290Q/298N/301S/304R/341F/366E/368D/ 395R, 8S/11M/23K/55S/57Y/69I/141E/165R/173V/ 189L/219L/223I/230V/233M/236R/237K/263G/267E/ 276I/279F/283H/290Q/298S/304R/341F/366E/368D/ 384G/395R, 8S/11M/23K/55S/57Y/69I/141E/165R/ 173V/189L/219L/223I/233Q/236R/237K/263G/267E/ 276I/279F/283H/290Q/298S/304R/341F/366E/368D/ 384G/395R, 8S/11M/23K/55S/57Y/69I/141E/165R/ 173V/189L/219L/223I/233S/236R/237K/263G/267E/ 276I/279F/283H/290Q/298S/304R/341F/366E/368D/

384G/395R, 8S/11M/23K/55S/57Y/69I/141E/165R/
173V/189L/219L/223I/233M/236R/237K/263G/267E/
276I/279F/283H/290Q/298S/304R/341F/362E/366E/
368D/395R/398G, 8S/11M/23K/55S/57Y/69I/141E/
165R/173V/189L/219L/223I/230V/236R/237K/263G/
267E/276I/279F/283H/290Q/298S/304R/341F/366E/
368D, 8S/11M/23K/55S/57Y/69I/141E/165R/173V/
189L/219L/223I/230V/233Q/236R/237K/263G/267E/
276I/279F/281V/283H/290Q/298S/304R/341F/366E/
368D, 8S/11M/23K/55S/57Y/69I/141E/165R/173V/
189M/219L/223I/230V/233S/236R/237K/263G/267E/
276I/279F/283H/290Q/298N/304R/341F/366E/368D/
395R/398G, 8S/11M/23K/55S/57Y/69I/141E/165R/
173V/189L/219L/223I/230V/233Q/236R/237K/263G/
267E/276I/279F/283H/290Q/298N/304R/341F/362E/
366E/368D, 8S/11M/23K/55S/57Y/69I/141E/165R/
173V/189L/219L/223I/230V/233M/236R/237K/263G/
267E/276I/279F/283H/290Q/298S/304R/341F/362E/
366E/368D/395R, 8S/11M/23K/55S/57Y/69I/141E/
165R/173V/189L/219L/223I/233M/236R/237K/263G/
267E/276I/279F/283H/290Q/298N/304R/308K/341F/
366E/368D/384G/395R, 8S/11M/23K/55S/57Y/69I/
141E/165R/173V/189L/219L/223I/233S/236R/237K/
263G/267E/276I/279F/283H/290Q/298S/304R/341F/
362E/366E/368D/395R, 8S/11M/23K/55S/57Y/69I/
141E/165R/173V/189L/219L/223I/236R/237K/263G/
267E/276I/279F/283H/290Q/298Y/301S/304R/341F/
366E/368D, 8S/11M/23K/55S/57Y/69I/141E/165R/
173V/189L/219L/223I/233M/236R/237K/263G/267E/
276I/279F/283H/290Q/298S/304R/341F/366E/368D,
8S/11M/23K/55S/57Y/69I/141E/165R/173V/189L/
219L/223I/236R/237K/263G/267E/276I/279F/283H/
290Q/298S/304R/341F/366E/368D/384G/398G,
8S/11M/23K/55S/57Y/69I/141E/165R/173V/189L/
219L/223I/236R/237K/263G/267E/276I/279F/283H/
290Q/298S/304R/341F/366E/368D/395R/398G,
8S/11M/23K/55S/57Y/69I/141E/165R/173V/189L/
219L/223I/236R/237K/263G/267E/276I/279F/283H/
290Q/298N/301S/304R/308K/341F/366E/368D/384G,
8S/11M/23K/55S/57Y/69I/141E/165R/173V/189L/
219L/223I/233Q/236R/237K/263G/267E/276I/279F/
283H/290Q/298R/304R/341F/362E/366E/368D,
8S/11M/23K/55S/57Y/69I/141E/165R/173V/189L/
219L/223I/230V/233Q/236R/237K/263G/267E/276I/
279F/283H/290Q/298R/301S/304R/341F/362E/366E/
368D/384G/395R, 8S/11M/23K/55S/57Y/69I/141E/
165R/173V/189L/219L/223I/230V/233S/236R/237K/
263G/267E/276I/279F/283H/290Q/298N/301S/304R/
341F/362E/366E/368D/384G/395R, 8S/11M/23K/
55S/57Y/69I/141E/165R/173V/189L/219L/223I/
236R/237K/263G/267E/276I/279F/283H/290Q/298S/
304R/341F/362E/366E/368D/384G, 8S/11M/23K/
55S/57Y/69I/141E/165R/173V/189L/219L/223I/
233Q/236R/237K/263G/267E/276I/279F/283H/290Q/
298S/304R/341F/366E/368D, 8S/11M/23K/55S/57Y/
69I/141E/165R/173V/189L/219L/223I/233G/236R/
237K/263G/267E/276I/279F/283H/290Q/298S/304R/
341F/366E/368D/395R, 8S/11M/23K/55S/57Y/69I/
141E/165R/173V/189L/219L/223I/233Q/236R/237K/
263G/267E/276I/279F/283H/290Q/298N/301S/304R/
341F/362E/366E/368D, 8S/11M/23K/55S/57Y/69I/
141E/165R/173V/189L/219L/223I/230V/233Q/236R/
237K/263G/267E/276I/279F/283H/290Q/298R/301S/
304R/341F/366E/368D/395R, or 8S/11M/23K/55S/
57Y/69I/141E/165R/173V/189L/219L/223I/230V/
233Q/236R/237K/263G/267E/276I/279F/283H/290Q/
298N/301S/304R/341F/366E/368D/395R, wherein the
amino acid positions are relative to the reference
sequence of SEQ ID NO: 2.

15. The recombinant methionine gamma lyase of claim 1, wherein the polypeptide sequence of the recombinant methionine gamma lyase comprises at least a substitution set 8S/11M/23K/55S/57Y/69I/141E/165R/173V/189L/219L/
220I/223I/236R/237K/263G/267E/276I/279F/283H/290Q/
298S/304R/341F/366E/368D, 8S/11M/23K/55S/57Y/69I/
141E/165R/173V/189P/219L/223I/236R/237K/263G/267E/
276I/279F/283H/290Q/298S/304R/341F/366E/368D,
8S/11M/23K/55S/57Y/69I/93L/141E/165R/173V/189L/
219L/223I/236R/237K/263G/267E/276I/279F/283H/290Q/
298S/304R/341F/366E/368D, 8S/11M/23K/55S/57Y/69I/
141E/165R/173V/189S/219L/223I/236R/237K/263G/267E/
276I/279F/283H/290Q/298S/304R/341F/366E/368D,
8S/11M/23K/55S/57Y/69I/141E/165R/173V/189L/219L/
221G/223I/236R/237K/263G/267E/276I/279F/283H/290Q/
298S/304R/341F/366E/368D, 8S/11M/23K/55S/57Y/69I/
141E/155F/165R/173V/189L/219L/223I/236R/237K/263G/
267E/276I/279F/283H/290Q/298S/304R/341F/366E/368D,
8S/11M/23K/55S/57Y/69I/141E/165R/173V/189L/219L/
223I/230V/236R/237K/263G/267E/276I/279F/283H/290Q/
298S/304R/341F/366E/368D, 8S/11M/23K/55S/57Y/63G/
69I/141E/165R/173V/189L/219L/223I/236R/237K/263G/
267E/276I/279F/283H/290Q/298S/304R/341F/366E/368D,
8S/11M/23K/55S/57Y/69I/141E/165R/173V/189L/219L/
223I/236R/237K/263G/267E/276I/279F/283H/284V/290Q/
298S/304R/341F/366E/368D, 8S/11M/23K/55S/57Y/69I/
141E/165R/173V/189L/219L/223I/236R/237K/263G/
267E/276I/279F/283H/290Q/298S/304R/308K/341F/366E/
368D, 8S/11M/23K/55S/57Y/69I/141E/165R/173V/189L/
219L/223I/236R/237K/263G/267E/276I/279F/283H/284E/
290Q/298S/304R/341F/366E/368D, 8S/11M/23K/55S/57Y/
69I/141E/165R/173V/189L/219L/223I/229G/236R/237K/
263G/267E/276I/279F/283H/290Q/298S/304R/341F/366E/
368D, 8S/11M/23K/55S/57Y/69I/141E/165R/173V/189L/
219L/223I/236R/237K/263G/267E/276I/279F/283H/284S/
290Q/298S/304R/341F/366E/368D, 8S/11M/23K/55S/57Y/
69I/141E/165R/173V/189L/199W/219L/223I/236R/237K/
263G/267E/276I/279F/283H/290Q/298S/304R/341F/366E/
368D, 8S/11M/23K/55S/57Y/69I/141E/165R/173V/189L/
219L/223I/236R/237K/263G/267E/276I/279F/283H/290Q/
298S/304R/341F/362E/366E/368D, 8S/11M/23K/55S/57Y/
69I/141E/165R/173V/189L/219L/223I/236R/237K/263G/
267E/276I/279F/283H/290Q/298S/304R/308S/341F/366E/
368D, 8S/11M/23K/55S/57Y/69I/141E/165R/173V/189L/
219L/223I/236R/237K/263G/267E/276I/279F/283H/290Q/
298S/301G/304R/341F/366E/368D, 8S/11M/23K/55S/57Y/
69I/141E/165R/173V/189L/219L/223I/236R/237K/263G/
267E/276I/279F/283H/290Q/298S/300R/304R/341F/366E/
368D, 8S/11M/23K/55S/57Y/69I/141E/165R/173V/189L/
219L/223I/236R/237K/263G/267E/276I/279F/283H/290Q/
298R/304R/341F/366E/368D, 8S/11M/23K/55S/57Y/69I/
141E/165R/173V/189L/219L/223I/236R/237K/263G/
267E/276I/279F/283H/290Q/298S/304R/341F/366E/368D/
395R, 8S/11M/23K/55S/57Y/69I/126R/141E/165R/173V/
189L/219L/223I/236R/237K/263G/267E/276I/279F/283H/
290Q/298S/304R/341F/366E/368D, 8S/11M/23K/55S/57Y/
69V/141E/165R/173V/189L/219L/223I/236R/237K/263G/
267E/276I/279F/283H/290Q/298S/304R/341F/366E/368D,
8S/11M/23K/55S/57Y/69I/141E/165R/173V/189L/219L/
223I/236R/237K/263G/267E/276I/279F/283H/290Q/298S/
304R/341F/366E/368D/395A, 8S/11M/23K/55S/57Y/69I/
141E/165R/173V/189L/219L/223I/233Q/236R/237K/
263G/267E/276I/279F/283H/290Q/298S/304R/341F/366E/
368D, 8S/11M/23K/55S/57Y/69I/141E/165R/173V/189L/
219L/223I/236R/237K/263G/267E/276I/279F/283H/290Q/

298S/304R/341F/366E/368D/384G, 8S/11M/23K/55S/57Y/69I/141E/165R/173V/189L/219L/223I/233V/236R/237K/263G/267E/276I/279F/283H/290Q/298S/304R/341F/366E/368D, 8S/11M/23K/55S/57Y/69I/141E/165R/173V/189L/219L/223I/236R/237K/263G/267E/276I/279F/283H/290Q/298S/304R/323S/341F/366E/368D, 8S/11M/23K/55S/57Y/69I/141E/165R/173V/189L/219L/223I/236R/237K/263G/267E/276I/279F/283H/290Q/298S/304R/341F/366E/368D/396Q, 8S/11M/23K/55S/57Y/69I/141E/165R/173V/189L/219L/223I/236R/237K/263G/267E/276I/279F/283H/290Q/298G/304R/341F/366E/368D, 8S/11M/23K/55S/57Y/69I/141E/165R/173V/189L/219L/223I/236R/237K/263G/267E/276I/279F/282Q/283H/290Q/298S/304R/341F/366E/368D, 8S/11M/23K/55S/57Y/69I/141E/165R/173V/189L/219L/223I/236R/237K/254A/263G/267E/276I/279F/283H/290Q/298S/304R/341F/366E/368D, 8S/11M/23K/55S/57Y/69I/141E/165R/173V/175V/189L/219L/223I/236R/237K/263G/267E/276I/279F/283H/290Q/298S/304R/341F/366E/368D, 8S/11M/23K/55S/57Y/69I/141E/165R/173V/189L/219L/223I/236R/237K/263G/267E/276I/279F/283H/290Q/298S/304R/341F/365R/366E/368D, 8S/11M/23K/55S/57Y/69I/141E/165R/173V/189L/219L/223I/236R/237K/263G/267E/276I/279F/283H/290Q/298S/304R/341F/366E/368D/396R, 8S/11M/23K/55S/57Y/69I/141E/165R/173V/189L/219L/223I/236R/237K/263G/267E/276I/279F/283H/290Q/298S/304R/308L/341F/366E/368D, 8S/11M/23K/55S/57Y/69I/141E/165R/173V/189L/219L/223I/236R/237K/263G/267E/276I/279F/283H/290Q/298S/304R/341F/366E/368D/398G, 8S/11M/23K/55S/57Y/69I/141E/165R/173V/189L/219L/223I/236R/237K/263G/267E/276I/279F/283H/290Q/298C/304R/341F/366E/368D, 8S/11M/23K/55S/57Y/69I/141E/165R/173V/189L/219L/223I/236R/237K/263G/267E/276I/279F/283H/290Q/298S/304R/341F/366E/368D, 8S/11M/23K/55S/57Y/69I/141E/165R/173V/189L/219L/223I/236R/237K/253G/263G/267E/276I/279F/283H/290Q/298S/304R/341F/366E/368D, 6P/8S/11M/23K/55S/57Y/69I/141E/165R/173V/189L/219L/223I/236R/237K/263G/267E/276I/279F/283H/290Q/298S/304R/341F/366E/368D, 8S/11M/23K/55S/57Y/69I/141E/165R/173V/189L/219L/223I/233G/236R/237K/263G/267E/276I/279F/283H/290Q/298S/304R/341F/366E/368D, 8S/11M/23K/55S/57Y/69I/141E/165R/173V/189L/219L/223I/236R/237K/263G/267E/276I/279F/283H/290Q/298S/304R/341F/366E/368D/384Q, 8S/11M/23K/55S/57Y/69I/82C/141E/165R/173V/189L/219L/223I/236R/237K/263G/267E/276I/279F/283H/290Q/298S/304R/341F/366E/368D, 8S/11M/23K/55S/57Y/69I/141E/165R/173V/189L/219L/223I/233S/236R/237K/263G/267E/276I/279F/283H/290Q/298S/304R/341F/366E/368D, 8S/11M/23K/55S/57Y/69I/141E/165R/173V/189L/219L/223I/236R/237K/263G/267E/276I/279F/283H/290Q/298S/304K/341F/366E/368D, 8S/11M/23K/55S/57Y/69I/141E/165R/173V/189L/219L/223I/233M/236R/237K/263G/267E/276I/279F/283H/290Q/298S/304R/341F/366E/368D, 8S/9R/11M/23K/55S/57Y/69I/141E/165R/173V/189L/219L/223I/236R/237K/263G/267E/276I/279F/283H/290Q/298S/304R/341F/366E/368D, 8S/11M/23K/55S/57Y/69I/141E/165R/173V/189L/219L/223I/236R/237K/263G/267E/276I/279F/283H/290Q/298S/301S/304R/341F/366E/368D, 8S/11M/23K/55S/57Y/69I/141E/165R/173V/189L/219L/223I/236R/237K/263G/267E/276I/279F/283H/290Q/298S/304V/341F/366E/368D, 8S/11M/23K/55S/57Y/69I/141E/165R/173V/189L/219L/223I/236R/237K/263G/267E/276I/279F/283H/290Q/298N/304R/341F/366E/368D, or 8S/11M/23K/55S/57Y/69I/141E/165R/173V/189L/219L/223I/236R/237K/263G/267E/276I/279F/283H/290Q/298S/304R/341F/366E/368D/384A, wherein the amino acid positions are relative to the reference sequence of SEQ ID NO: 2.

16. The recombinant methionine gamma lyase of claim 1, wherein the polypeptide sequence of the recombinant methionine gamma lyase comprises SEQ ID NO: 4, 6, 8, 12, 14, 16, 18, 20, 22, 24, 26, 28, 30, 34, 36, 38, 40, 44, 46, 48, 50, 52, 54, 56, 58, 60, 62, 64, 66, 70, 72, 74, 76, 78, 80, 82, 84, 86, 88, 90, 94, 96, 158, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 470, 468, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 648, 650, 652, 654, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, or 878.

17. The recombinant methionine gamma lyase of claim 1, wherein the polypeptide sequence of the recombinant methionine gamma lyase comprises SEQ ID NO: 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, or 1286.

18. The recombinant methionine gamma lyase of claim 1, wherein the polypeptide sequence of the recombinant methionine gamma lyase comprises SEQ ID NO: 1288, 1290, 1292, 1294, 1296, 1298, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, or 1734.

19. The recombinant methionine gamma lyase of claim 1, wherein the recombinant methionine gamma lyase exhibits at least one improved property selected from: i) enhanced catalytic activity; ii) increased tolerance to acid pH; iii) increased thermotolerance; iv) increased tolerance to pH 5.2; v) increased tolerance to at least one protease; and vi) increased activity in the presence of substrate concentration of 0.25 mM methionine; or a combination of any of i), ii), iii), iv), v), and vi), as compared to a reference methionine gamma lyase having the sequence of SEQ ID NO: 2.

20. A composition comprising a recombinant methionine gamma lyase of claim 1.

21. A pharmaceutical composition comprising a recombinant methionine gamma lyase of claim 1.

22. The pharmaceutical composition of claim 21, further comprising a pharmaceutically acceptable carrier and/or excipient.

23. The pharmaceutical composition of claim 21, wherein the composition is suitable for oral administration to a human.

24. The recombinant methionine gamma lyase of claim 1, wherein the polypeptide sequence of the recombinant methionine gamma lyase comprises SEQ ID NO: 94, 248, 352, 478, 832, 916, 1172, 1232, 1346, 1488 or 1706.

* * * * *